United States Patent 11,713,471 (CLASS II, TYPE V CRISPR SYSTEMS) - sequence listing, part 2

SEQ ID NO: 1984 - protein, 538 aa, Unknown
  Description of Unknown: uncultivated organism sequence
  Category: MG81 effectors
  Description: MG81-262 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPTMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1985 - protein, 534 aa, Unknown
  Description of Unknown: uncultivated organism sequence
  Category: MG81 effectors
  Description: MG81-263 effector
MGWKSTGRGGTRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLKLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNVMPDGERIQRDLYSAFLLQHCRRDLPEYNRKELQKEFGEELYRVFDREALQRDYPRFVAYHHMTIQRLSELPHTIPSMGIRRIIS

SEQ ID NO: 1986 - protein, 550 aa, Unknown
  Description of Unknown: uncultivated organism sequence
  Category: MG81 effectors
  Description: MG81-264 effector
MGWKSKGRGGTLVDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNCDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1987 - protein, 482 aa, Unknown
  Description of Unknown: uncultivated organism sequence
  Category: MG81 effectors
  Description: MG81-265 effector
MPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYPAFLLQHCKQGLPEYNRKELKKEFGEELYRVFDREALQRDYPQFVAYHHMTIQRLSELPHTIPSMGIRRIIS

SEQ ID NO: 1988 - protein, 512 aa, Unknown
  Description of Unknown: uncultivated organism sequence
  Category: MG81 effectors
  Description: MG81-266 effector
MPTKQKEDSNRCVLTLPLLTEPWQEHKKKKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1989 - protein, 534 aa, Unknown
  Description of Unknown: uncultivated organism sequence
  Category: MG81 effectors
  Description: MG81-267 effector
MGWKSKGRGGKRVKKSSTDTCCLTLPLKLEKWQSDRLEKRFEIGRQIYNTVVRAELKKLHQVERTPQYREIEQKLKEAKQEEAKELWKKRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSSNNDYETEMLSKRVKYVRILRKEGKTKPHWYAQLVLEGKPAIKRDPASGAPKHPVGHGVVGIDIGTRTLAYSADSKVDLIELADRVQNIELEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRIIS

SEQ ID NO: 1990 - protein, 521 aa, Unknown
  Description of Unknown: uncultivated organism sequence
  Category: MG81 effectors
  Description: MG81-268 effector
MMVMWKGGIPVGKSSTDTCCLTLPLKLEKWQEDRLAKRFEIARQIYNTMVRAELKKLDRVKQLPEYRKNQKEIQALDWKNSADKQRLKELYGNQRKILQKQGFTEYGFKADSKDYYKHFIENIGSSVATHGIAPQVWNAFDKMLFQKDGKVVHFKRYGDVHSLKGGSVAHKSGGAEIMFRKTYIEWKGLKLPLKLSPNNAYEAEMLSYRVKYVRILRTRGKTKDRWYAQLSLEGKPAVKYDSNTGKPVHPVGRGAVGLDIGPQTLAYAGANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEETGRIKRKKRFGKSVANKAPASLIGILKLKCISLGLTGVVEVPMLLRASQYNHQSKDYAKKSLSQRWNDMPDGNRIQRDLYSAFLLQHYDSRSESFDQETLERDYPQFVRLHNQTIQRLSALPKTPSSMGIRRSVS

SEQ ID NO: 1991 - protein, 529 aa, Unknown
  Description of Unknown: uncultivated organism sequence
  Category: MG81 effectors
  Description: MG81-269 effector
MAKNNNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKCGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 1992 - protein, 512 aa, Unknown
  Description of Unknown: uncultivated organism sequence
  Category: MG81 effectors
  Description: MG81-270 effector
MKKSSTDTCCLTLALKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKVLFKKGGKKVHYKRPGEVNSVQGYSRTGKSGGREIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAARVAGLVELADRVQNIEQEKRCLQRKMDRSRRAANPDNYAEDGTIRRGVKLTHNKSKRYRRSQQELKYLQHRQVEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPSSMGIRRSIA

SEQ ID NO: 1993 - protein, 511 aa, Unknown
  Description of Unknown: uncultivated organism sequence
  Category: MG81 effectors
  Description: MG81-271 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVGIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 1994 - protein, 548 aa, Unknown
  Description of Unknown: uncultivated organism sequence
  Category: MG81 effectors
  Description: MG81-272 effector
MGWKSKGRGGTRVNNEEKEKDGATCCLTLPLKLEKWQSDHLEKRFEIARQLYNTLVHAELKRIHRIERMPEYREIERLIEATTDKKEKWALKNQKKQFLRKNGINRNTFTMDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRKEGKTKPHWYAQLVLEGKPAIKRDPASGAPKHPVGHGVVGIDIGTRTLAYSADSKVDLIELADRVQNIEQEKLLLQRKLDRSRRATNPENYKPDGTIKKGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRIFDREALQRDYPKFVEYHRETIQRLSALPKTIASMGIRRSIS

SEQ ID NO: 1995 - protein, 1387 aa, Unknown
  Description of Unknown: uncultivated organism sequence
  Category: MG81 effectors
  Description: MG81-273 effector
MKLTKVEKARIAVSREKKDSGRIILYTNPEDVKKTSVTTMEQQVSKRIDQANKLYQVFFKSVIPVELNKHFAEISKIAAKCRNTEEFYKKACGYSGYEWTDAKQKKRTSQISRFSYTSSGKNMYVVMDNFVKEYMVQIWQEKDFRNAAVKILCCICDGKKFASKLEKVKKESPDTLKKFIEISGKCEGNPFVDYDTSFLEKVFTLVISQMVKNCDRKSYEQDDKEKIKKSIQKEIQWLSHVQSVTERSFGREGKTYLLFKIRNPYATEERLQTVLIRMRKTLKRGRNRDIAIVLLQGLAQMNQVTFTDTVKHLYQEEEKAFCDFIDAVNRDYYRVNIVKSVRNMDVKVQPDLNDNSILKLSGLGNIKKEALSDTLLRYAASADESDQVLLDIKKLLFEYFLPENSKETSKYTTVQNLWNIPYLPKIFFDYGFENEDSDDDNECAEDIETLCDVEPQYKINQHSLKRRIRYVNYGKYLQMTKNESDRERRYWIHYIKEFVEKNYVDSGRTLSEKNCYASSMMLNCWKEIIRYLCGKYIDIGKAVFHFTNLTAMPKPKDKIIYGQLEEQYKKGISSFDYEAIKAEETLQRDIVQSVVAAAFAFSKSVIDETKMEECQETNKEDILFLSENVLGSLLKENTIKLILRFYGGESSVAQKEYFDQQEIVQEMISHLKSIRNENFHYLDGAKKDNPHKYASILWKNDEMAYQKLTKQRYYANNVGLFYRAEEIQELVQELYSQKNITEAQIPAFRTVLKRKDLPGYMEELGILFPDNTQEKSKGDFEGTLYFLMKEIYYRDFIVKDKAAAYFFKAVDQNKEQSKKEDKHTERAAENFHRYVKSLEKKYNKKEISFGTVCQYIMMEYNQQNTTKQETEIYKHFKMLISLCIRKAFGNYIKETYRFLFHPIYSKQQGEPEYLDTLELESGVKEKNYEWFTLAHFLHPVQLNHLVGDLKSYIQYREDILRRIVFAEQRVYADQQKEVQQKVKTAKEILEVLEFVREVSGRVSNEYTDYYENEEEYAEFLYQYIDFRKREGKSAFESLKYFCQNILDSGTVVDLYADTENPKVLRNIELTRMYAGSNVKIPEYEKITEDEIKMYYQEKNSVALILSRGLCRNEKEQKKVIEFNWKKKRLTLNEITDVFSLVNDLLGKMISFSYLRERDQMYLLLGFYYMALCAENKSENHLGWKGETLDKLESSDSKFDIGGGLVLYQIVSAFNFGSKLLYISEDGRWKMAGGAFPGKYGRFENDYNHRTSLSKVIRLFENESYEREIIYWRDYVDHMKYYVNQNQSIMEIYSAFYSKVLGYSAKLRKSVVFNLQAALEKHHINPECIWMTSDGKCADIKLMKNLESQKFTYKLAKREGEKTERKICMNALNENFLKTIRTSLEYKK

SEQ ID NO: 1996 - protein, 536 aa, Unknown
  Description of Unknown: uncultivated organism sequence
  Category: MG81 effectors
  Description: MG81-274 effector
MNNEEKEKDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRKEGKTKPHWYAQLVLEGKPTVKRDPISGAPKHPVGHGVVGIDIGTRTLAYSTDSEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYDRKELKKEFGEELYRVFDREALQRDYPQFVAYHHMTIQRLSELPHTIPSMGIRRIIS

SEQ ID NO: 1997 - protein, 550 aa, Unknown
  Description of Unknown: uncultivated organism sequence
  Category: MG81 effectors
  Description: MG81-275 effector
MGWKSKGRGGTLVDNEEKKEDGATCCLTLPLKLEKWQSDHLEKRFEIARQLYNTLVHAELKKKCQVERMPEYQEIMKMIDTASNQKEKWALEKKRKAFLEENGFIRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 1998 - protein, 511 aa, Unknown
  Description of Unknown: uncultivated organism sequence
  Category: MG81 effectors
  Description: MG81-276 effector
MKRSGTDTCCLTLPLRLEKWQEDRLAKRFEIARQIYNTMVRAELKKLRKMELSQPYRSIQEQIKALDWKNQNDKQQLRSLYNERDQLLKKNGFTEYGFKSDIKYYYKYFNDNIGSSVAVHGIAPQVWAAFEKMLFRKEGKKVHYKKKDDIHSLRGYSVTGKSGGVEIIFHETYIEWKGLKLPLKLSPHNAYETEMLSRRVKYVRLLRKPGKRKDRWYAQLSLEGKPAIKHNPASGELRHPVGQGAVGLDIGPQTLAYSACCAADLVELADRVQNIEQVKRLLLRKMDRSRRATNPDNYTDDGTIRRGVKLTHNKSKRYQRTQRELRYLQHCQAEMRKRQHIELANHLLTLGDRFYVEDMAWPSLTRRAKETAISEKTGKIKRKKRFGKSIANKAPAALIGILEQKCYSLGLPGVVKVPTSLKASQYNHQSGEYTPKPLSRRWNNMPDGERIQRDLYSAFLLQHYDPQTGNFDPVLLQQDYPQFVQYHHCAIQRLSAMPRTLSSMGIQRSLR

SEQ ID NO: 1999 - protein, 534 aa, Unknown
  Description of Unknown: uncultivated organism sequence
  Category: MG81 effectors
  Description: MG81-277 effector
MGWKSKGRGGTLVKKSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSADSKVDLIELADRVQNIEQEKMLLQRKLDRSRRATNPENYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRIIS

SEQ ID NO: 2000 - protein, 499 aa, Unknown
  Description of Unknown: uncultivated organism sequence
  Category: MG81 effectors
  Description: MG81-278 effector
MAKGKKKNQSVRCVLTLPLLTEPWQDKIIETRFHIMERIKNILISKELGKLKSLERTREWKKLKKDIEKCKEKDEEEKKILYEQRSKMIYDAGLSKNHFVVDITPIQKHFAEHIATQIAHMSASDVWRSFEKYFYGSGQRIHFVEYDKLNSIACEKIGNGMNLKDWKLVWGGGRCPNKISLTIKVRLPRNDYEREMMQKPIKYLRVVRKWMKTRYKYYLQITFEGNPVIKSRPVGNGRVGIDIGTQTIAWSSDTEVRLAELAAGIKQNQKKIAELKRKMDRSRRAMNPQNYNSNGTAKRGRHKWVKSKRYIRMRGILRELERKNADIRKYEHTCMVNHILSLGNQIYIEDMNWIALARRAKRTKKNKNGRYAKKKRFGKSIGKRAPGMFMLILKQKCNLVGGEYHEVDKSTFKASQYDHITDTFRKKPLGKRWNVLGGTDNVQRDMYSSFLIKNSDDTYMQTDRNRCIDTYTHFKELHDIEIERLMNENKKHLSSMGVA

SEQ ID NO: 2001 - protein, 551 aa, Unknown
  Description of Unknown: uncultivated organism sequence
  Category: MG81 effectors
  Description: MG81-279 effector
MSNLLFLLENEEKMRYNGVEKQREGEGTRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2002 - protein, 522 aa, Unknown
  Description of Unknown: uncultivated organism sequence
  Category: MG81 effectors
  Description: MG81-280 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKEGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRIIS

SEQ ID NO: 2003 - protein, 538 aa, Unknown
  Description of Unknown: uncultivated organism sequence
  Category: MG81 effectors
  Description: MG81-281 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILCKDGKTKPHWYAQLVLEGKPAVKRDPISSAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2004 - protein, 550 aa, Unknown
  Description of Unknown: uncultivated organism sequence
  Category: MG81 effectors
  Description: MG81-282 effector
MGRKSTGRGGTRVNNEEKEKDGATCCLTLPLKLEKWQSDHLEKRFEIARQLYNTLVHAELKKKCQVVRMPEYQEIMKMIDAASNQKEKWALEKKRKAFLGENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2005 - protein, 1387 aa, Unknown
  Description of Unknown: uncultivated organism sequence
  Category: MG81 effectors
  Description: MG81-283 effector
MKLTKVEKARIAVSREKKDSGRIILYTNPEDVKKTSVTTMEQQVSKRIDQANKLYQVFFKSVIPVELNKHFAEISKIAAKCRNTEEFYKKACGYSGYEWTDAKQKKRTSQISRFSYTSSGKNMYVVMDNFVKEYMVQIWQEKDFRNAAVKILCCICDGKKFASKLEKVKKESPDTLKKFIEISGKCEENPFVDYDTSFLEKVFTLVISQMVKNCDRKSYEQDDKEKIKKSIQKEIQWLSHVQSVTERSFGREGKTYLLFKIRNPYATEERLQTVLIRMRKTLKRGRNRDIAIVLLQGLAQMNQVTFTDTVKHLYQEEEKAFCDFIDAVNRDYYRVNIVKSVRNMDVKVQPDLNDNSILKLSGLGNIKKEALSDTLLRYAASADESDQVLLDIKKLLFEYFLPENSKETSKYTTVQNLWNIPYLPKIFFDYGFENEDFDDDNECAEDIETLCDVEPQYKINQHSLKRRIRYVNYGKYLQMTKNESDRERRYWIHYIKEFVEKNYVDSGRTLSEKNCYASSMMLNCWKEIIRYLCGKYIDIGKAVFHFTNLTAMPKPKDKIIYGQLEEQYKKGISSFDYEAIKAEETLQRDIVQSVVAAAFAFSKSVIDETKMEECQETNKEDILFLSENVLGSLLKENTIKLILRFYGGESTVAQKEYFDQQEIVQEMISHLKSIRNENFHYLDGAKKDNPHKYASILWKNDEMAYQKLTKQRYYANNVGLFYRAEEIQELVQELYSQKNITEAQIPAFRTVLKRKDLPGYMEELGILFPDNTQEKSKGDFEGTLYFLMKEIYYRDFIVKDKAAAYFFKAVDQNKEQSKKEDKHTERAAENFHRYVKSLEKKYNKKEISFGTVCQYIMMEYNQQNTTKQETEIYKHFKMLISLCIRKAFGNYIKETYRFLFHPIYSKQQGEPEYLDTLELESGVKEKNYEWFTLAHFLHPVQLNHLVGDLKSYIQYREDILRRIVFAEQRVYADQQKEVQQKVKTAKEILEVLEFVREVSGRVSNEYTDYYENEEEYAEFLYQYIDFRKREGKSAFESLKYFCQNILDSGTVVDLYADTENPKVLRNIELTRMYAGSNVKIPEYEKITEDEIKMYYQEKNSVALILSRGLCRNEKEQKKVIEFNWKKKRLTLNEITDVFSLVNDLLGKMISFSYLRERDQMYLLLGFYYMALCAENKSENHLGWKGETLDKLESSDSKFDIGGGLVLYQIVSAFNFGSKLLYISEDGRWKMAGGAFPGKYGRFENDYNHRTSLSKVIRLFENESYEREIIYWRDYVDHMKYYVNQNQSIMEIYSAFYSKVLGYSAKLRKSVVFNLQAALEKHHINPECIWMTSDGKCADIKLMKNLESQKFTYKLAKREGEKTERKICMNALNENFLKTIRTSLEYKK

SEQ ID NO: 2006 - protein, 536 aa, Unknown
  Description of Unknown: uncultivated organism sequence
  Category: MG81 effectors
  Description: MG81-284 effector
MNNEEKEKDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRKDGKTKPHWYAQLVLEGKPAIKRDPASGAPKHPIGHGVVGIDIGTRTLAYSADSKVDLIELADRVQNIEQEKLLLQRKLDRSRRATNPENYKPDGTIKKGVKLTWNNSKRYKRIQHQYAMIQHHQADIRKQQHNELANYLLTLGDCFFVEDMDYRALTRKAKETEISEKTGRYKRKKRFGKSIANKAPSMLITLLDQKCKSLNLEGVKKVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRSIS

SEQ ID NO: 2007 - protein, 522 aa, Unknown
  Description of Unknown: uncultivated organism sequence
  Category: MG81 effectors
  Description: MG81-285 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKEGKTKTHWYAQLALEGKPAVKRDSISGAPKHPVGHGVVGIDIGTRTLAYSTDSEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2008 - protein, 530 aa, Unknown
  Description of Unknown: uncultivated organism sequence
  Category: MG81 effectors
  Description: MG81-286 effector
MANNNNNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGREIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPSLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTITSMGVRRSHS

SEQ ID NO: 2009 - protein, 550 aa, Unknown
  Description of Unknown: uncultivated organism sequence
  Category: MG81 effectors
  Description: MG81-287 effector
MGWKSKGRGGTLVDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDGIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2010 - protein, 511 aa, Unknown
  Description of Unknown: uncultivated organism sequence
  Category: MG81 effectors
  Description: MG81-288 effector
MGKSSTDTCCLTLPLKLEKWQEDRLAKRFEIARQIYNTMVRAELKRLRQVEQSPQYRSNKKAIQALDWKNTADKPKLKTLYRERDKLLKGGGFTKYGFKSDIKNFYKHFAENIGSSVAVHGIAPQVWAAFERVLFKKEGKKVHFKKTGDIRSLRGYSVTGKSGGVEIIFRGSYIEWKGLNLPLKLSPDNAYETEMLSYRVKYVRILRKPGKTRDRWYAQLSLEGKPAIKRNPASGNPVHPVGQGTVGLDIGPQTLAYAAEKEANLVELADRVQNIEREKHLLQRKMDRSRRAANPDNYAENGTIRRGVKLTHNKSKRYLRLQRELCYLQHCQAETRKRQHTELANHLLSLGSCFYVEDMAWPSLTHRAKKTEISDKTGRIKRKKRFGKSIANKAPAALINILRTKCVSLGIPGVVEVPTSLKASQYNHQSKEYTPKPLSQRWNDMPDGSRIQRDLYSAFLLQHYDPQSGNFDQASLEADYPQFVQLHNQSIQRLLTVPKTPSSMGIRRSVS

SEQ ID NO: 2011 - protein, 532 aa, Unknown
  Description of Unknown: uncultivated organism sequence
  Category: MG81 effectors
  Description: MG81-289 effector
MILLAKNNNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2012 - protein, 512 aa, Unknown
  Description of Unknown: uncultivated organism sequence
  Category: MG81 effectors
  Description: MG81-290 effector
MPTKQKEDSNRCVLTLPLLTEPWQEHIIEKRFKIIEHLKNQLISIELRKLKNLQRTKAYKNLMKRIESVPKAERTALYKERNKMLEGKGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2013 - protein, 467 aa, Unknown
  Description of Unknown: uncultivated organism sequence
  Category: MG81 effectors
  Description: MG81-291 effector
MAKCSTDTCCLTLPLRLEKWQEDRLAKRFEIARQIYNTMVRAELKKLRAMEQSEPYKANQEKIQALDRKTQTDKQALKALYKERDKLLRDGGFSEYGFKSDIKNYYKHFNNNIGSNVAFHGIAPQVWAAFEKMLFKKEGKKVHFKKKGDIRSLRGYSVTGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYANDGTIRRGIALTHNQSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQLRIFITALRPANKHF

SEQ ID NO: 2014 - protein, 511 aa, Unknown
  Description of Unknown: uncultivated organism sequence
  Category: MG81 effectors
  Description: MG81-292 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTHKPLSQRWNNMPDGERIQRDLYSAFLLQHYDPQTNTFDANSLHQDYPQFVQYHHDAVLRLYAMPKAPSSMGIKRSLR

SEQ ID NO: 2015 - protein, 510 aa, Unknown
  Description of Unknown: uncultivated organism sequence
  Category: MG81 effectors
  Description: MG81-293 effector
MKKCSTDTCCLTLPLKLEKWQEDRLAKRFELARQIYNTMVHAELKKLKALEHSEQYQEIQEQLRVLTQKEHQDKKKLRLLYKARDELLKSWGFSEYGFKENIKYYYKHFNKNIGSSVAFHGIAPQVWTAFEKVLFGNGKKVHYKRFGEMRSLRGFSSTGKSGGVEIMFRGTYIEWKGLKLLLKLSPNNAYENEMLSYRVKYVRLIRKPGKQKDRWYAQLVLEGKPAVKYDLGTGKAIHPVGSGAVGLDIGPQTLAYSASSEADLVELADQVQNIEQIKCRLQRKMDRSRRATNPDNYKDDGTIKRGVKLTHNKSKRYCKIQRELKYLQHCQAETRKRQHIQLANHLISLGDCFYVEEMSWAALVHRSKKTEVSEKTGRFKRKKRFGKSIANKAPRSMIEILRQKCISLGVPGVIEVPTSVRASQYNHQSDEYTKKTLSQRWNLMPDGQRIQRDLYSAFLLQHYDPKTENFDSDSLQHDYPQFVIYHQQVIQRLSVIPKTPSSMGIYRSVR

SEQ ID NO: 2016 - protein, 512 aa, Unknown
  Description of Unknown: uncultivated organism sequence
  Category: MG81 effectors
  Description: MG81-294 effector
MKKSSTDTCCLTLPLKLEKWQEDRLAKRFEIARQLYNTLVHAELKRLAQVKQTAEYRENERKIRTLDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKRCLQRKMGRSRRATNPDNYAEDGTIRRGVKLTHNKSKRYRRSQQELKYLQRRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNDMQDGEHLQRDLYSAFLLQHYDSMSKALDLDSLARDYPAFVQYHHQEIERLHALPKTPASMGIRRSIA

SEQ ID NO: 2017 - protein, 602 aa, Unknown
  Description of Unknown: uncultivated organism sequence
  Category: MG81 effectors
  Description: MG81-295 effector
MTTILRAYKTELDPTDEQRVVLARHVAGARVAHNWALEKWKELDGTRGVALGCRALAGIDAKGGEAAALFGYCLAALIRGEPVKVRTPKSEAGSRYRYRPASGVQLPDFRAGRVDWYSQLVSAKEEQPERFGWLSELSAFAIREAVLDVADGWKHFFEHLKAGRYASAGPPRFRGRQRASYHSDQPDPIRVTERAVKIPGVGWVRMKERGYLPVTEENSHRFIGGGKACGLGVSEKDGRWYVALRCEVPRPFPQKRGPGRALAMHQTKRVPGRELGVEVGVRVLAVASTGERAGHVWHSPLRDDRRIDKFEMLRKRWERRMARRWKDGVKTRDQSQGWKEAAMRVAHYHARIKSLRDDVCGKAARQIADMGAETVRMRGPGIAKMLSRAGKRGDAARTRNRLAKNVHAARMGDLRRRLEYKQAWAGGRLELVPIEEPTTNRCSACNAVRDTNAGYPTFMCPTCGYQEDRDDNSAINLLNYRAPSGDPAAGPRSAGLKPPKGDNGRRKRTARAEEKSSVTAPHGDVTSAPGPGNRVSGASHSVRPIDAYHEVPFEQSGDAHLGSRQFGLDTALFGADDPNRSQIEPQRSEFPGLLAHRAGGTS

SEQ ID NO: 2018 - protein, 525 aa, Unknown
  Description of Unknown: uncultivated organism sequence
  Category: MG81 effectors
  Description: MG81-296 effector
MTKNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLKASQYNHLSDTYEKKSLSERWNYMPISDGSDSSKTKRIQRDLYSAFLLQHTIPQPCSFDKEALREDYPNFVTMHDAEIHRLEYLPKTITSMGVRRSHS

SEQ ID NO: 2019 - protein, 527 aa, Unknown
  Description of Unknown: uncultivated organism sequence
  Category: MG81 effectors
  Description: MG81-297 effector
MAKKNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKCGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 2020 - protein, 542 aa, Unknown
  Description of Unknown: uncultivated organism sequence
  Category: MG81 effectors
  Description: MG81-298 effector
MATTDKKDEDKEKLRAYKFRLDPNQAQTIALYQAAGAARYTYNMLTAYNLEVNRLRDEYWKKRHDEGISDADIKKELNALAKEDKRYKQLKYGAFGTQYLTPEKKRHEQAEHRIENGEDPSVVWNQETERSANPWLHTANRRVLVSGLQNASDAWDNFWDSRTGKRAGRLVGTPRFKKKGVSRDSFTVPAAEKMGAYGAAYLRGEPAYKQGRRKITDYRHVRLSYLGTIRTFNSTKPLVKAVAAGAKIRSYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATGYTLVGFEDLNVSGMTASAKGTVENPGKNVAQKSGLNRVVLDAAFGVFRNQLEYKAVWYGSAFEKVNRYFASSQTCSECGRKAKTKLTLRDRVFDCAYCGNMMDRDFNAAVNICREAQRLFDEKLASEDGESLNGRGSRGALRGAKTVEASRPPASHRRGSP

SEQ ID NO: 2021 - protein, 514 aa, Unknown
  Description of Unknown: uncultivated organism sequence
  Category: MG81 effectors
  Description: MG81-299 effector
MGNSSTDTCCLTLPLKLEKWQEDRLAKRFELARQIYNTLVRAELKKLERVKHSAPYREIQGQIQALDWSNPNDKGALRRLYKARDALLKSSGFTEYSFKSDIKYYYKHFSDNIGSDVAFHGIAPQVWTAFEKVLFKGGKKIHYKQYGDVSSVQGYSKTRKSGGREIMFRGTYIEWKGLKLPLKLSPDNAYENEMLRYRIKFVRLVRKPGKQKDRWYAQLVLEGKPVVKREPATGEAVHPVGSGVVGLDIGPRTLAYSAPGEAGLVELADQVQNIEQAKCRLQRKLDRSRRATNPDNYSENGTIRRGVKLTRNKSKRYRKIQNQLKYLQYCQAETRKRQHTQLANHLLSLGDSFYVEDMPWPALARRAKETVVSEKTGRIKRKKRFGKSIANKAPATLTRILKQKCTSLGLPGVVEVPTSVRASQYNHQTGEYIKKPLSQRWNNMPDGQRIQRDLYSAFLLQHYDPGTGTFDSASLQRDYPQFTQYHHQVIQHLLSMPKTLSSMGIRQSIRQYEF

SEQ ID NO: 2022 - protein, 1387 aa, Unknown
  Description of Unknown: uncultivated organism sequence
  Category: MG81 effectors
  Description: MG81-300 effector
MKLTKVEKARIAVSREKKDSGRIILYTNPEDVKKTSVTTMEQQVSKRIDQANKLYQVFFKSVIPVELNKHFAEISKIAAKCRNTEEFYKKACGYSGYEWTDAKQKKRTSQISRFSYTSSGKNMYVVMDNFVKEYMVQIWQEKDFRNAAVKILCCICDGKKFASKLEKVKKESPDTLKKFIEISGKCEGNPFVDYDTSFLEKVFTLVISQMVKNCDRKSYEQDDKEKIKKSIQKEIQWLSHVQSVTERSFGREGKTYLLFKIRNPYATEERLQTVLIRMRKTLKRGRNRDIAIVLLQGLAQMNQVTFTDTVKHLYQEEEKAFCDFIDAVNRDYYRVNIVKSVRNMDVKVQPDLNDNSILKLSGLGNIKKEALSDTLLRYAASADESDQVLLDIKKLLFEYFLPGNSKETSKYTTVQNLWNIPYLPKIFFDYGFENEDSDDDNECAEDIETLCDVEPQYKINQHSLKRRIRYVNYGKYLQMTKNESDRERRYWIHYIKEFVEKNYVDSGRTLSEKNCYASSMMLNCWKEIIRYLCGKYIDIGKAVFHFTNLTAMPKPKDKIIYGQLEEQYKKGISSFDYEAIKAEETLQRDIVQSVVAAAFAFSKSVIDETKMEECQETNKEDILFLSENVLGSLLKENTIKLILRFYGGESSVAQKEYFDQQEIVQEMISHLKSIRNENFHYLDGAKKDNPHKYASILWKNDEMAYQKLTKQRYYANNVGLFYRAEEIQELVQELYSQKNITEAQIPAFRTVLKRKDLPGYMEELGILFPDNTQEKSKGDFEGTLYFLMKEIYYRDFIVKDKAAAYFFKAVDQNKEQSKKEDKHTERAAENFHRYVKSLEKKYNKKEISFGTVCQYIMMEYNQQNTTKQETEIYKHFKMLISLCIRKAFGNYIKETYRFLFHPIYSKQQGEPEYLDTLELESGVKEKNYEWFTLAHFLHPVQLNHLVGDLKSYIQYREDILRRIVFAEQRVYADQQKEVQQKVKTAKEILEVLEFVREVSGRVSNEYTDYYENEEEYAEFLYQYIDFRKREGKSAFESLKYFCQNILDSGTVVDLYADTENPKVLRNIELTRMYAGSNVKIPEYEKITEDEIKMYYQEKNSVALILSRGLCRNEKEQKKVIEFNWKKKRLTLNEITDVFSLVNDLLGKMISFSYLRERDQMYLLLGFYYMALCAENKSENHLGWKGETLDKLESSDSKFDIGGGLVLYQIVSAFNFGSKLLYISEDGRWKMAGGAFPGKYGRFENDYNHRTSLSKVIRLFENESYEREIIYWRDYVDHMKYYVNQNQSIMEIYSAFYSKVLGYSAKLRKSVVFNLQAALEKHHINPECIWMTSDGKCADIKLMKNLESQKFTYKLAKREGEKTERKICMNALNENFLKTIRTSLEYKK

SEQ ID NO: 2023 - protein, 538 aa, Unknown
  Description of Unknown: uncultivated organism sequence
  Category: MG81 effectors
  Description: MG81-301 effector
MDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2024 - protein, 511 aa, Unknown
  Description of Unknown: uncultivated organism sequence
  Category: MG81 effectors
  Description: MG81-302 effector
MAKCSTDTCCLTLPLRLEKWQEDRLAKRFEIARQIYNTMVRAELKKLRAIEQSEPYKANQEKIQALDWKTQADKRALKALYKERDKLLRAGGFSERGFKSDIKNYYMHFNNNIGSNVAAHGIAPQVWAAFEKMLFKKEGKKVHFKKKGDIHSLRGYSVTRKSGGVEIIFRETYIEWKGLKLPLKLSPDNIYETQMLSYRVKYVRLLRKSGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDRFYVEKMAWTSLTHRAKETEISEKTGKIKRKKRFGKSVANKAPATLIGILQRKSAALGIPGVIEVPTSVKASQYNHQSGTYTPKPLSQRWNNMPDGKRIQRDLYSAFLLQHYDPQTNTFDANSLHQDYPQFVQYHHDAVLRLYAMPKTPSSMGIKRSLR

SEQ ID NO: 2025 - protein, 512 aa, Unknown
  Description of Unknown: uncultivated organism sequence
  Category: MG81 effectors
  Description: MG81-303 effector
MKKSSTDTCCLTLPLKLEKWQEDRLAKRFEIARQLYNTLVHAELKRLAQVKQTAEYRENERKIRTLDWNDPGDQAKPKGLYKERRKSLKTAGFTDYSFTTDMGKYYKHFRDNIGSSVAVHGIAPQVWAAFDKVLFKKGGKKVHYKRPGEVNSVQGYSRTGKSGGREIMFRGAYIEWKGLKLPLKLSPDNAYETDMLQRRLKLVRLVRRPGKRRDRWYAQLVLEGKPAIKADPVTGKAVHPIGSGPIGLDIGPQTLAYSAAGVAGLVELADRVQNIEQEKRCLQRKMDRSRRATNPDNYAEDGTIRRGVKLTHNKSKRYRRSQQELKYLQHRQAEIRKLQHIQLANHLLSLGDHFYVEKMEWSSLTHRAKETVISEKTGKPRSKRRFGKSIANKAPAMLIEILRQKCKSLGLSDVVEINPADIKASQYNHLTGEYVKKSLSRRWNDMQDGEHLQRDLYSAFLLQHYDSCSKTLDHDSIVRDYPAFVQYHHREIERLHALPKTPSSMGIRRSIA

SEQ ID NO: 2026 - protein, 534 aa, Unknown
  Description of Unknown: uncultivated organism sequence
  Category: MG81 effectors
  Description: MG81-304 effector
MGWKSKGRGGTLVKKSSTDTCCLTLPLKLEKWQSDRLEKRFEIGRQIYNTVVRAELKKLQQVERTPQYREIEQKLKEAKQEEAKELWKTRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISENTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRSIS

SEQ ID NO: 2027 - protein, 511 aa, Unknown
  Description of Unknown: uncultivated organism sequence
  Category: MG81 effectors
  Description: MG81-305 effector
MGKSKTETCCLTLPLKLEKWQEDRLAKRFEIARQIYNTLVHAKLKKLNQIERSSEYQTIQDQITNLDRNDPERIKELPSLYKKRTKLLRDAGFTEYGFKSDVKHYYKYFHKNIGSSVAVHGIAPQVWAAFEKKLFKKQGKIVHYKRKGTLRSVKGGSATGKSGGTEIIFRGTYIQWKDLNLPLKRSPDNAYESEMLGYRVKYVRILRKPGKSKNRWYAQLVLEGKPVIKRNPMTGAALHPVGHGAVGLDIGPQTLAYSAADGVGLLELADQVQNIERQKALLQRKLDQSRRASNPDNYNEDGTIKRGVKLTRNQSKRYCKTQRDLAYLQHCQAETRKRQHIALANHLLTLGDRFYVEQMSWVALARRSKKTEVSEKTGKIKRKKRFGKSIANKAPAMLIEILRQKCISLGLPGVVDVPTSIKASQYNHQSKDYIKKNLSERWNDMPDGEKIQRDLYSAFLLQHCTPELNAFDQESLQQDYPQFVQYHHQVMQQLSEMPKTPSSMGIRRRTS

SEQ ID NO: 2028 - protein, 538 aa, Unknown
  Description of Unknown: uncultivated organism sequence
  Category: MG81 effectors
  Description: MG81-306 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGRKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2029 - protein, 522 aa, Unknown
  Description of Unknown: uncultivated organism sequence
  Category: MG81 effectors
  Description: MG81-307 effector
MKRSSTDTCCLTLPLKLEKWQSDRLEKRFEIGRQIYNTIVHAELKKLRKLERTQQYQEIEQKLENAKQEETKELWKKKRQLLDQNGLSEDHFKADMKYYYPHFKDNIASNVAVHGIASQAWTAFEKVLFSKDGKMVHFKKKGELSSLRGYSRAGKSGGVEIIFRGSYVEWKGLKLPLKLSPDNDYETEMLSKRVKYVRILRKDGKTKTHWYAQLALEGKPAVKRDSISGVPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNVMPDGERIQRDLYSAFLLQHCRRDLPEYNRKELQKEFGEELYRVFDREALQRDYPRFVAYHHMTIQRLSELPHTIPSMGIRRIIS

SEQ ID NO: 2030 - protein, 550 aa, Unknown
  Description of Unknown: uncultivated organism sequence
  Category: MG81 effectors
  Description: MG81-308 effector
MGRKSTGRGGTRVNNEEKEKDGATCCLTLPLKLEKWQSDHLEKRFEIARQLYNTLVHAELKKKCQVVRMPEYQEIMKMIDAASNQKEKWALEKKRKAFLGENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2031 - protein, 485 aa, Unknown
  Description of Unknown: uncultivated organism sequence
  Category: MG81 effectors
  Description: MG81-309 effector
MDNEEKEKDGATCCLTLPLKLEKWQSDHLEKRFEIARQLYNTLVHAELKKKCQVVRMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLRNIIGRN

SEQ ID NO: 2032 - protein, 511 aa, Unknown
  Description of Unknown: uncultivated organism sequence
  Category: MG81 effectors
  Description: MG81-310 effector
MGKSSTDTCCLTLPLKLEKWQEDRLAKRFEIARQIYNTMVRAELKRLRQVEQSPQYRSNKKAIQALDWKNTADKPKLKTLYRERDKLLKGGGFTEYGFKSDIKNFYKHFAENIGSSVAVHGIAPQVWAAFERVLFKKEGKKVHFKKTGGIRSLRGYSVTGKSGGVEIIFRGSYIEWKGLNLPLKLSPDNAYETEMLSYRVKYVRILRKPGKTRDRWYAQLSLEGKPAIKRNPASGNPVHPVGQGAVGLDIGPQTLAYAAEKEANLVELADRVQNIEREKHLLQRKMDRSRRAANPDNYAENGTIRRGVKLTHNKSKRYLRLQRELCYLQHCQAETRKRQHTELANHLLSLGSCFYVEDMAWPSLTHRAKKTEISDKTGRIKRKKRFGKSIANKAPAALINILRTKCVSLGIPGVVEVPTSLKASQYNHQSKEYTPKPLSQRWNDMPDGSQIQRDLYSAFLLQHYDPQSGNFDQASLEADYPQFVQLHNQSIQRLLTVPKAPSSMGIRRSVS

SEQ ID NO: 2033 - protein, 512 aa, Unknown
  Description of Unknown: uncultivated organism sequence
  Category: MG81 effectors
  Description: MG81-311 effector
MKKSSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKVLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKHCLQRKMDRSRRATNPDNYAEDGTIRRGVKLTHNKSKRYRRSQQELKYLQRRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPASMGIRRSIA

SEQ ID NO: 2034 - protein, 534 aa, Unknown
  Description of Unknown: uncultivated organism sequence
  Category: MG81 effectors
  Description: MG81-312 effector
MGWKSKGRGGTLVKKSSTDTCCLTLPLKLEKWQSDRLEKRFEIGRQIYNTVVRAELKKLQQVERTPQYREIEQKLKEAKQEEAKELWKTRTQLLSKSGFSEYGFKSDMKYYYQHFKENIGSSVAVHGIASQAWTAFEKVLLSKDGKMVHFKKKRELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRIIS

SEQ ID NO: 2035 - protein, 512 aa, Unknown
  Description of Unknown: uncultivated organism sequence
  Category: MG81 effectors
  Description: MG81-313 effector
MPAKQKEDSNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVAPVKTNYEKEMVANNEIKYYRVVRKWMKTKYKYYLQITFAGKPADKHHEVSTDRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2036 - protein, 385 aa, Unknown
  Description of Unknown: uncultivated organism sequence
  Category: MG81 effectors
  Description: MG81-314 effector
MKTLKLRILDKHVPKLGQVASACNYVWNYVNALGFTHLQRTGKFFGAYDIALYTKGAGELLGLHSQTIQAITETYVKSRKQFCKAKLKWRTNRHDSKHKALGWIPFKKSAVKVLPSRQTGRKKRKTGIVLSLAKGCKLHIEVWDSYNLDLYQANTCELVQDSRGRWYACITVKDFPKTKCGTNKVGIDLGLKTAATTSNGDQLITKVTQAYAKALGTAQRAGNKARVKAINAKIRHTRQDLIHKFTTNLVKDSAVIVVGDVKSTAIIQPRKRDKPTNQQTTPRPHRKRMKLAKSVYDAGWFELKRQLEYKCKHAGCQLEIVSERMTTQTCSCCGNTTGSPKGRTGLGIREWTCGTCHTTHDRDINAARNILAVGLHRLDVGIPSL

SEQ ID NO: 2037 - protein, 532 aa, Unknown
  Description of Unknown: uncultivated organism sequence
  Category: MG81 effectors
  Description: MG81-315 effector
MILLANNNNNNNNNTDTCVLTLPLRVEKWQEDCLLKRFEAARRIYNSLLNFELKKLRQLERTVEYRQIQSVISSAYRSNTKDSLECKDAFKRREKLISANGISENGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2038 - protein, 511 aa, Unknown
  Description of Unknown: uncultivated organism sequence
  Category: MG81 effectors
  Description: MG81-316 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGERRHSIGWGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2039 - protein, 398 aa, Unknown
  Description of Unknown: uncultivated organism sequence
  Category: MG81 effectors
  Description: MG81-317 effector
MKTLKLKVRKEAYNWLNAAAKETNTVWNWTKETRLKALNFNYDCNHEFHYNEETGRYQRKILSRGTWLSNEDKWAPKTSIWLSHYDLTKLTKGATKDDLFKHLPMQSINLVVKEYVRKSIQFKKSELRWRKSMGSKRNLGWIPFQAQGLSRCKNKKYIKFAGKTFRVFEHNRLNEGKWCDGCFSEDSVGDWWLCIPIKTTQSENKIAPGEAVGIDLGIRKVATTSKPSNSLATIRSYRDTEDKIKEAQRRGHKRQAKRLHRKAANQRKDILHKYSTKLVDGYQEIYIGDLNSKFLSGSKLAKSASDNAIGMLKDMVQYKGERAGRTVKIVNERYTTQDCSVCGSRSGPKGQLDIREWTCTECGTTHDRDVNAAKNILKLGKLTFVRDNSATTTPCCKK

SEQ ID NO: 2040 - protein, 538 aa, Unknown
  Description of Unknown: uncultivated organism sequence
  Category: MG81 effectors
  Description: MG81-318 effector
MDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIASMGIRRSIS

SEQ ID NO: 2041 - protein, 354 aa, Unknown
  Description of Unknown: uncultivated organism sequence
  Category: MG81 effectors
  Description: MG81-319 effector
MKTLKIRIKDSNQTKLLCQLASEVNLVWNYCNELGFKYLQRTGKFLSAYDIDKYTAGASKECGLHSQTIQAISNEYVTRRKQFKKSKLSWRVSNPKSAKCSLGWIPFKKSAIKYGKGFIQYGKNIFKLWDSYNLSQFDIYTGSFVQDSRGRWYVCVTVDTPKQLPNQATKAIGIDLGLKDLATCSDGTKISNPKYYSHYQAKLGKSQRANKKRLVQTLHAKIKNSRKDYLQKQSTQLVKDNGLIIVGSLSANKLTKTKMAKSVNDTGFSAFKTMLKYKCENAGVWFVEVSENYTTQICSCCGEISANSPKGRINLGIREWTCSLCNATHDRDVNASKNILRLGHQTLAGGIPSL

SEQ ID NO: 2042 - protein, 511 aa, Unknown
  Description of Unknown: uncultivated organism sequence
  Category: MG81 effectors
  Description: MG81-320 effector
MKKSNTDTCCLTLPLKLEKWQEDRLAKRFEIARKIYNTMVHAELKKLRNIENSQPYRQIQKQIEALNWKNQNDKARLKTLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGKIKRKKRFGKSVANKAPATLIGILEQKCNSLGLPGVIKVPTSLRASQYNHQSGEYTSKPLSQRWNNMPDGERIQRDLYSAFLLQHYDPQAGNFDSALLQQDYPQFVQYHHRAIQRLSTVPKTLSSMGIQRSLR

SEQ ID NO: 2043 - protein, 341 aa, Unknown
  Description of Unknown: uncultivated organism sequence
  Category: MG81 effectors
  Description: MG81-321 effector
MLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLKASQYNHLSDTYEKKSLSERWNYMPISDGSDSSKTKRIQRDLYSAFLLQHTIPQPCSFDKEALRIDYPNFVTMHDAEIHRLESLPKTITSMGVRRSHS

SEQ ID NO: 2044 - protein, 511 aa, Unknown
  Description of Unknown: uncultivated organism sequence
  Category: MG81 effectors
  Description: MG81-322 effector
MGKSSTDTCCLTLPLKLEKWQEDRLAKRFEIARQIYNTMVRAELKKLDRVKQLPEYRKNQKEIQALDWKNSADKQRLKELYGNQRKILQKQGFTEYGFKADSKDYYKHFIENIGSSVATHGIAPQVWNAFDKMLFQKDGKVVHFKRYGDVHSLKGGSVAHKSGGAEIMFRKTYIEWKGLKLPLKLSPDNAYEAEMLSYHVKYVRILRTRGKTKDRWYAQLSLEGKPAVKYDSNTGKPVHPVGKGAVGLDIGPQTLAYVAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEKTGRIKRKKRFGKSVANKAPASLIGILKLKCISLGLTGVVEVPKLLKASQYNHQSKDYAPKSLSQRWNDMPDGNRIQRDLYSAFLLQHYNSQLENFNQETLERDYPQFVRLHNQTIQRLSALPKTPSSMGIRRSVS

SEQ ID NO: 2045 - protein, 533 aa, Unknown
  Description of Unknown: uncultivated organism sequence
  Category: MG81 effectors
  Description: MG81-323 effector
MILLANNNNNNNNNNTDTCVLTLPLRVEKWQEDCLLKRFEAARRIYNSLLNFELKKLRQLERTVEYRQIQSVISSAYRSNTKDSLECKDAFKRRKKLTDENGISEYGFKSDVKFFYKHFDGLIGSNVAVHCIAVQLWVAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2046 - protein, 536 aa, Unknown
  Description of Unknown: uncultivated organism sequence
  Category: MG81 effectors
  Description: MG81-324 effector
MILLANNNNNNNNNNNNNTDTCVLTLPLRVEKWQEDCLLKRFEAARRIYNSLLNFELKKLRQLERTVEYRQIQSVISSAYRSNTKDSPECKDAFKRRKKLTDENGISEYGFKSDVKFFYKHFDGLIGSSVAVHCIAVQLWAAFDKYLRGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLLGVVEVDTFRLRASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2047 - protein, 528 aa, Unknown
  Description of Unknown: uncultivated organism sequence
  Category: MG81 effectors
  Description: MG81-325 effector
MILLAKNNNNTDTCVLTLPLRVEKWQEDCLLKRFEAARRIYNSLLNFELKKLRQLERTVEYRQIQSVISSAYRSNTKDSPECKDAFKRREKLISANGISKSGFKSDVKFFYKHFDGLIGSNVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2048 - protein, 534 aa, Unknown
  Description of Unknown: uncultivated organism sequence
  Category: MG81 effectors
  Description: MG81-326 effector
MILLANNNNNNNNNNNTDTCVLTLPLRVEKWQEDCLLKRFEAARRIYNSLLNFELKKLRQLERTVEYRQIQSVISSAYRSNTKDSLECKDAFKRREKLISANGISENGFKSDVKFFYKHFDGLIGSSVAVHCIAVQLWAAFDKYLSGSGKEIHFKRLGDISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2049 - protein, 523 aa, Unknown
  Description of Unknown: uncultivated organism sequence
  Category: MG81 effectors
  Description: MG81-327 effector
MPTKQKEGGNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGSGQMIHYQKRGTLKSIASKSPKNGMHYFPESNTFKWSGGKQKKIGQKGEQKKVSIKPISLCLRVSPLKTDYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVRRGTKGHKLKWNKSKHYLEIAGKIRELERKNSDIRKYQHTCLANDILAMGNQIYIEPMNYKGLQKKAKETQVDEKGRYKKKKRFGKSLANKAPSMFVTILKTKAEQHGGEVYEVDIMSYRASQCDHTTGEYTKHGLNDRWRILGNGDKVQRDLYSAFLIKNSNKTHDEIDLDKCSKTYDNFKKLHDTEIENIRNEVKLRERKNISSYGIT

SEQ ID NO: 2050 - protein, 512 aa, Unknown
  Description of Unknown: uncultivated organism sequence
  Category: MG81 effectors
  Description: MG81-328 effector
MPTKQKEDSNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVAPVKTNYEKEMVANNEIKYYRVVRKWMKTKYKYYLQITFAGKPADKHHEVSTGRVGIDIGTQTIAIASDKSVKLLELADKVNKNHIKKCELQRKLDRSRRYTNPDNFNPDGTVKRGTKAHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 2051 - protein, 534 aa, Unknown
  Description of Unknown: uncultivated organism sequence
  Category: MG81 effectors
  Description: MG81-329 effector
MGWKSKGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSADSKVDLIELADRVQNIEQEKMLLQRKLDRSRRATNPENYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRSIS

SEQ ID NO: 2052 - protein, 511 aa, Unknown
  Description of Unknown: uncultivated organism sequence
  Category: MG81 effectors
  Description: MG81-330 effector
MKKSNTDTCCLTLPLKLEKWQEDRLAKRFEIARQIYNTMVHAELKKLRNIENSQPYRQIQKQIEALNWKNKNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLKGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVIKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2053 - protein, 534 aa, Unknown
  Description of Unknown: uncultivated organism sequence
  Category: MG81 effectors
  Description: MG81-331 effector
MGRKSTGRGGTLVKKSSTDTCCLTLPLKLEKWQSDRLEKRFEIGRQIYNTVVRAELKKLQQVERTPQYREIEQKLKGAKQEEAKELWKKRTQLLSKSGFSEYGFKSDMKYYYQHFKENIGSSVAVHGIASQVWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2054 - protein, 511 aa, Unknown
  Description of Unknown: uncultivated organism sequence
  Category: MG81 effectors
  Description: MG81-332 effector
MAKCSTDTCCLTLPLRLEKWQEDRLAKRFEIARQIYNTMVRAELKKLRAIEQSEPYKANQEKIQALDWKTQADKQALKALYKERDKRLRDGGFSEYGFKSDIKNYYKHFNNNIGSSVAVHGIAPQVWAAFEKMLFKKEGKKVHFKKKGDIRSLRGYSVTGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDTNSLHQDYPQFVQYHHDAVLRLYAMPKTPSSMGIKRSLR

SEQ ID NO: 2055 - protein, 511 aa, Unknown
  Description of Unknown: uncultivated organism sequence
  Category: MG81 effectors
  Description: MG81-333 effector
MGKSSTDTCCLTLPLKLEKWQEDRLAKRFEIARQIYNTMVRAELKKLDRVKQLPEYRKNQKEIQALDGKNSADRARLKELRANQNRILQKQGFTEYGFKADSKDYYKHFIENIGSSVATHGIAPQVWNAFDKMLFQKDGKVVHFKRYGDVHSLKGGSVAHKSGGAEIMFRKTYIEWKGLKLPLKLSPNNAYEAEMLSYRVKYVRILRTRGKTKDRWYAQLSLEGKPAVKYDSNTGKPVHPVGRGAVGLDIGPQTLAYAAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEETGRIKRKKRFGKSVANKAPASLIGILRLKCISLGLTGVVEVPMLLRASQYNHQSKDYAKKSLSQRWNDMPDGNRIQRDLYSAFLLQHYNSQLENFDQETLERDYPQFVRLHNQTIQRLSALPKTPSSMGIRRSVS

SEQ ID NO: 2056 - protein, 512 aa, Unknown
  Description of Unknown: uncultivated organism sequence
  Category: MG81 effectors
  Description: MG81-334 effector
MPTKQKEDSNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNTDIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2057 - protein, 512 aa, Unknown
  Description of Unknown: uncultivated organism sequence
  Category: MG81 effectors
  Description: MG81-335 effector
MKKSSTDTCCLTLPLKLEKWQEGRLAKRFEIARQLYNTLVHAELKRLAQVKQTAEYRENERKIRTLDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKRCLQRKMGRSRRATNPDNYAEDGTIRRGVKLTHNKSKRYRRSQQELKYLQRRQAEIRKLQHIQLANHLLSLGDHFYVEKMEWSSLTHRAKKTVISEKTGKPRSKKRFGKSIANKAPAMLIEILRQKCKSLGLPNVVEINPVDIKASQYNHLTGEYVKKSLSRRWNEMQDGEHLQRDLYSAFLLQHYDSMSKALDLDSLARDYPAFVQYHHQEIERLHALPKTPSSMGIRRSIA

SEQ ID NO: 2058 - protein, 536 aa, Unknown
  Description of Unknown: uncultivated organism sequence
  Category: MG81 effectors
  Description: MG81-336 effector
MDNVEKEKDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRNEGKTKPHWYAQLVLEGKPAIKRDPASGAPKHSVGHGAVGIDIGTRTLAYSADSKVDLIELADRVQNIEQEKLLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRIIS

SEQ ID NO: 2059 - protein, 512 aa, Unknown
  Description of Unknown: uncultivated organism sequence
  Category: MG81 effectors
  Description: MG81-337 effector
MKKSSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSASGAAGLVELADRVQNIEQEKRRLQRKMDRSRRATNPDNYAEDGTIRRGVKLTHYKSKRYRRSQQELKYLQHRQAEIRKLQHIQFANHLLSLGDHFYVEKMEWSSLTHRAKETVISEKTGKPRSKRRFGKFIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPASMGIRRSIA

SEQ ID NO: 2060 - protein, 536 aa, Unknown
  Description of Unknown: uncultivated organism sequence
  Category: MG81 effectors
  Description: MG81-338 effector
MVNDDYNKVLKQFHKLSNRHILVAETDMSCSDIQKVVKLSDRIRKAGNELIGLMKKNYDQLMRTKRYRGLLKLYGSTKNKQKRKMFADQLNEMQKQYNVTWDYCRKSMIHIGKKYSIDAVFALTKAEDVWHGVEKCLYGNGKTLHFSKHGDLPCIRAKQINRGIPISAKNNQLQFKLGKSVFGIQIKDRFQTDEVNAVLDYLAAPEIADCKAVQTLLEEACCISTYRPCYATLVPKLIRGKYRVYLHLAIEGRAKPKYDRFGNPRHKYGKGIIGADIGTQTVAYTSDTETGLKNLSDRGNSIQTSERLERLYYRAMDRSRRATNPQNYNDDGTVKQGKKTWNYSNHYKKLKAKHAELCRINAANRRLAINEDANHLRSIGDVFITEPKNAAKLMKRASKTTVNNKGKINKKKRFGKSIKNRCPGGFQTAVENKFKASGGTYIEVSNNYRASQYDHTADDYIKKKLSDRMYKLADGTLVQRDWYSSFLLYCYDFRTSDIDKDKCAAKFDKCYSMERELIEWIKTNKIKVLNSGIKIA

SEQ ID NO: 2061 - protein, 511 aa, Unknown
  Description of Unknown: uncultivated organism sequence
  Category: MG81 effectors
  Description: MG81-339 effector
MAQRHSTPTCCLTLPLQLEKWQEDRLIKRFEIAGKIYNALLNAELKKLHRLEQLPEYKEIQSQLKAYYQNNLPKTAAFKELNNRRSKLLSEHGFSEYAFKGDMKKFYKHFSSNIGSSVATHCIASQVWSAFEKRLFGGGKFVHFKKSGDIRSLKGFSSSRKSGGVEIMFRGDHIEWKGLLLRLKLDPDNQYESEMLSRRIKYVRIIRKPGKAKWRWYAQLSVEGLPAIKRNDETGEPVHPIGRGAVGIDIGPQTIAYVSQTEVALKELADRVQNIEHEKRLIQRKLDRSRRATNPANYADNGTIKRGVKLTRNKSKRYLKLQMELSFLQHKQAEIRKQQHINLANHLLSLGDCFYVEDMAWSSLARKAKETAVSEKTGKYKRKKRFGKSIANKAPASLISILDQKCTSLGLLGVIKVPTSVRASQYNHITKSYEKKTLSQRWNIMPDGRRIQRDIYSAFLLQHVTPQRDGFSDEALQQDYENFVSLHDSVFQQLRLMPKTIASMGIRRTYS

SEQ ID NO: 2062 - protein, 352 aa, Unknown
  Description of Unknown: uncultivated organism sequence
  Category: MG81 effectors
  Description: MG81-340 effector
MYTTLNYRIKDSNVSDTLNKWASDANRIWNMCNEINMISWQKFQRPMSGFDLGYSAKGMSKMMAIPQRSIGCICTEYATRTKQFKKRKLNWRSYKKNTGWIPFATQQMKCFSDGIFFNGQKFKLWDYKPFDEKTIKSGSFQQDARGRWYVSITVEIEASSEIPKTGKAVGIDLGLKSLVTLSDGTVYDRVNLTEMYAKKLATAQLAGNLMQVRNIHAKIKNTRKNFYHEISLAIVKNYDEIYIGNISSSKLIKTKMAKSVSDAAWYDFKFMLKYKAERAGKKFVEVNESFSTVTCSSCLERTGPSGLSALGVRSWICSHCGAAHDRDVNAAKNILRSGQCADLRVKGSSLKN

SEQ ID NO: 2063 - protein, 512 aa, Unknown
  Description of Unknown: uncultivated organism sequence
  Category: MG81 effectors
  Description: MG81-341 effector
MKKSNTDTCCLTLPLKLEKWQEDRLAKRFEIARQLYNTLVHAELKRLAQVKQTAEYRENERKIRALDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEAKPAIKADPVTGKAVHPIGSGPVGLDIGPQTLAYSAAGAAGLVELADRVQNIEQEKRRLQRKMDRSRRATNPDNYAEDGTIRRGVKLTHNKSKRYRRSQQELKYLQHRQAEIRKLQHIQFANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPSSMGIRRSIA

SEQ ID NO: 2064 - protein, 550 aa, Unknown
  Description of Unknown: uncultivated organism sequence
  Category: MG81 effectors
  Description: MG81-342 effector
MGWKSKGRGGTLVDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIASMGIRRSIS

SEQ ID NO: 2065 - protein, 524 aa, Unknown
  Description of Unknown: uncultivated organism sequence
  Category: MG81 effectors
  Description: MG81-343 effector
MAKNNNTDTCVLTLPLRVEKWQEDCLLKRFEAARRIYNSLLNFELKKLRQLERTVEYRQIQSVISSAYRSNTKDSPECKDAFKRREKLISANGISKSGFKSDVKFFYKHFDGLIGSNVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVIMHDAEIHRLESLPKTVTSMGVRRSHS

SEQ ID NO: 2066 - protein, 511 aa, Unknown
  Description of Unknown: uncultivated organism sequence
  Category: MG81 effectors
  Description: MG81-344 effector
MAARSKTDTCCLTLPLRLEKWQADRLAKRFHIAEQIYNAMLLSWIKKLRVVEQMPEYRAIQSQLQKLYEEDKQKTDAAKELFSRRKEILKKNGFSEYSFKTGIRKYYAHFKENIASNVATHCIASQVWDAFSKKLFGNGGRLHFKRAGDIHSLRGYSKSGESGGVEIIFRGTYIEWNGLRLPLKLDPQNPYEAEMLAKRVKYVRILRTPGKSIDHWYAQLALEGKPTVKRNAATGEPVHPSGRGAVGIDIGPRTIAYVSENEVGLRELADQVENIERDKRRLQRKLDRSRRATNPDNYAPDGTIKRGIKHTHNKSSRYRRMQKELSLLQHRQALIRKRQHTELANHLLSLGDCFYVEDMPWKGLARRTKETTVSPTTGRYRRKKRFGKSISNKAPGTLILILEQKCKSRGVSGVIRVPTNIKASQYNHMTDTYKPKPLSQRWNDMPDGKRIQRDLYSAFLLQHVTPELDGFERTKLIEDYDGFIHLHDKEIHELTLAPKTIASMGISRTRS

SEQ ID NO: 2067 - protein, 349 aa, Unknown
  Description of Unknown: uncultivated organism sequence
  Category: MG81 effectors
  Description: MG81-345 effector
MIQRQIKLRLKPKQEALLNDWLWQCTGLFNWAIRKIELDAQGGVYYTKQGFQNILAGHSRKMGMPSHTMQAMLTQAYIGWQRCFKKLAKKPRLKGMRNKLNSIPFPDPLKQPVQNKIKVPGLGQVRFHKQSLPDGKIKCGRIIKRASGWYLALTIDAEPNIKHTFKAKNNRVVGIDPGFKDVIALSDGEKKKATLEYNQGLQRLAQAQRGHDKKLVARLHERIANRKKDRNHKLSRHLVETCELIAFSKDNIKGIQRKFGKSVANANIYQLRQMIDYKSSSCDRRYVEVDGKYSTMTCSACGSRTGPTGIAGLRVRYWTCGCGTKHDRDINAAINTLNTAVGSTVELAA

SEQ ID NO: 2068 - protein, 512 aa, Unknown
  Description of Unknown: uncultivated organism sequence
  Category: MG81 effectors
  Description: MG81-346 effector
MKKSSTDTCCLTLPLKLEKWQEDRLAKRFEIARQLYNTLVHAELKRLVQIKRTAEYRENERKIRTLDWNNPAHRTELEKLYEERRKSLKKAGFTDNSFTTDMGKYYKHFRDNIGSSVAVHGIAPQVWAAFDKLLFKKGGKKVHCKRPGEVNSVQGYSRTGKSGGREIMFRGAYIEWKGLKLPLKLSPDNAYETDMLQRRVKLVRLVRRPGKRRDRWYAQLVLEGKPAIKADPVTGKAVHPIGSGPVGLDIGPQTLAYSAAGVAGLVELADRVQNIEQEKRCLQRKMDRSRRATNPDNYAEDGTIRRGVKLTHNKSKRYRRNQQELKYLQHRQAEIRKLQHIQLANHLLSLGDHFYVEKMEWSSLTRRAKKTVISEKTGKPRSKKRFGKSIANKAPAMLIEILRQKCKSLGLPNVVEINPADIKASQYNHLTGEYVKKSLSRRWNDMQDGEHLQRDLYSAFLLQHYDSMSKALDLDSLSRDYPAFVQYHHQEIERLHALPKTPASMGIRRSIA

SEQ ID NO: 2069 - protein, 536 aa, Unknown
  Description of Unknown: uncultivated organism sequence
  Category: MG81 effectors
  Description: MG81-347 effector
MVNDDYNKVLKQFHKLSNRHILVAETDMSCSDIQKVVKLSDRIRKAGNELIGLMKKNYDQLMRTKRYRGLLKLYGSTKNKQKRKMFADQLNEMQKQYNVTWDYCRKSMIHIGKKYSIDAVFALTKAEDVWHGVEKCLYGNGKTLHFSKHGDLPCIRAKQINRGIPISAKNNQLQFKLGKSVFGIQIKDRFQTDEVNAVLDYLAAPEIADCKAVQTLLEEACCISTYRPCYATLVPKLIRGKYRVYLHLAIEGRAKPKYDRFGNPRHKYGKGIIGADIGTQTVAYTSDTETGLKNLSDRGNSIQTSERLERLYYRAMDRSRRATNPQNYNDDGTVKQGKKTWNYSNHYKKLKAKHAELCRINVANRRLAINEDANHLRSIGDVFITEPKNAAKLMKRASKTTVNNKGKINKKKRFGKSIKNRCPGGFQTAVENKFKASGGTYIEVSNNYRASQYDHTADDYIKKKLSDRMYKLADGTLVQRDWYSSFLLYCYDFRTSDIDKDKCAAKFDKCYSMERELIEWIKTNKIKVLNSGIKIA

SEQ ID NO: 2070 - protein, 538 aa, Unknown
  Description of Unknown: uncultivated organism sequence
  Category: MG81 effectors
  Description: MG81-348 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISSAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2071 - protein, 534 aa, Unknown
  Description of Unknown: uncultivated organism sequence
  Category: MG81 effectors
  Description: MG81-349 effector
MGWKSKGRGGTRVKKSSTDTCCLTLPLKLEKWQSDRLEKRFEIGRQIYNTVVRAELKKLHQLERTPQYREIEQKLKEAKQEEAKELWKKRTQLLSQSGFTEYGFKSDMKYYYQHFKENIGSSVAVHGIASQVWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKELQKEFGEELYRVFDREALQRDYPQFVVYHHMTMQRLSALPKTIASMGIRRSIS

SEQ ID NO: 2072 - protein, 538 aa, Unknown
  Description of Unknown: uncultivated organism sequence
  Category: MG81 effectors
  Description: MG81-350 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISSAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2073 - protein, 511 aa, Unknown
  Description of Unknown: uncultivated organism sequence
  Category: MG81 effectors
  Description: MG81-351 effector
MKKSNTDTCCLTLPLKLEKWQEDRLAKRFEIARQIYNTMVHAELKKLRNVENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLDRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2074 - protein, 334 aa, Unknown
  Description of Unknown: uncultivated organism sequence
  Category: MG81 effectors
  Description: MG81-352 effector
MLSKRVKYVRILRKDGKTKTHWYAQLALEGKPAVKRDSISGAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMLDGERIQRDLYSAFLLQHCKQGLPEYNRKELKKEFGEELYRVFDREALQRDYPQFVAYHHMTIQRLSELPHTIPSMGIRRIIS

SEQ ID NO: 2075 - protein, 540 aa, Unknown
  Description of Unknown: uncultivated organism sequence
  Category: MG81 effectors
  Description: MG81-353 effector
MATTDKKNEENLRAYKFRLDPNQAQTIALYQAAGAARYTYNMLTAYNLEVNRLRDDYWKKRHDEGISDADIKKELNALTKEDKRYKQLKYGAFGTQYLTPEKKRHEQAEHRIENGEDPSVVWNQETERSANPWLHTANQRVLVSGLQNASDAWDNFWASRTGKRAGRLVGTPRFKKKGVSRDSFTVPAPEKMGAYGTAYLRGEPAYKQGRRKITDYRHVRLSYLGTIRTFNSTKPLVKAVAAGAKIRRYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATEYTLVGFEDLNVSGMTASAKGTVENPGKNVAQKSGLNRVVLDAAFGVFRNQLEYKAVWYGSAFEKVDRYFASSQTCSECGRKAKTKLTLRDRVFDCAYCGNMMDRDLNAAVNICREAQRLFDEKLASEDRESLNGRGSRGALRGAETVEASRPPASHRRGSP

SEQ ID NO: 2076 - protein, 536 aa, Unknown
  Description of Unknown: uncultivated organism sequence
  Category: MG81 effectors
  Description: MG81-354 effector
MNEKEYKKSLRQFHKHSDRHILVVETDMSFSDIQKVVALSDKIRKAGNELVGLMIKNYDQLIRTKRYRKVRKLYGATEEKKKRKVLASQLNEMQKQYHVTWDDCRTSMIPIGKKYGIDAVFALTKTEDVWRGIEKCLYANGKTLHFSKYGVLPCIRAKQMNRGIPISVKENQLQFKFGESTFGIQRKDRFQSDEIHAVLDYLAEPEIIDKKAIQTFVEKAYCINTYRPCYATLVPKLIRGKYRVYLHLTIEGKAKPKQDRFGNPRHKFGKGIIGADIGTQTVAYTSDTEVGLKNLSERGNSIQKSERLERLYYRAMDRSRRATNPQNYNEDGTIKKGRKSWKYSNHYKRLKAKHAELCRINARNRQLAINEDANSLRSLGDVLITEPKNASKLMKRAKETTKNKKGKFNKKKRFGKSIKSRCPGGFQSTIEKKFEVSGGRYIEVPGNYRASQYDHTADTYVKKKLSDRMYHLADGTLVQRDWYSSFLLYCYDDKIEEINKTKCRTEFEKHYKKEKALIEWIQANQIKILNSGIKTA

SEQ ID NO: 2077 - protein, 554 aa, Unknown
  Description of Unknown: uncultivated organism sequence
  Category: MG81 effectors
  Description: MG81-355 effector
MNNEEKEKDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGKPAIKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2078 - protein, 512 aa, Unknown
  Description of Unknown: uncultivated organism sequence
  Category: MG81 effectors
  Description: MG81-356 effector
MGKSSTDTCCLSLPLKLEKWQEDRLAKRFEIARQIYNTLVHAELKRLSQVKRSQQYREIENKIRALDRNDQEDKKELSLLHKLRDDLLRKSGFNDYGFKADIKYFYKHFGENIGANVAVHGIAPQVWSAFDSVLFKKRGKKVHYKKPGDICSLRGYSVTGKSGGSEIMFRGTYIEWKGLKMPLKLSPDNIYESEMLDHRVKYVRIVRKPGKRKDRWYAQLSLECKPVIKCDPVSGEMRHPVGKGPVGLDIGPQTLAYCALSEAGLVELADQVQDIEREKQRLQRRLDRSRRAANPNNYAADGTIKRGVKLTHNKSKRYCILQRELRYLQQQQAETRKRQHTELANYLLSLGDRFYVEDMNWSSLARRAKKTEISEKTGRYKRKKRFGKSIANKAPGSLIDILKQKCESLGIPGVEKLPTSLLKASQYNHQTGEYTPKPRSQRWNDMPDGERIQRDLYSAFLLQHYDPVSKGYDQAALQRDYPQFLQHHHHSIQRLTAKPKTPSSMGIHQRLR

SEQ ID NO: 2079 - protein, 594 aa, Unknown
  Description of Unknown: uncultivated organism sequence
  Category: MG81 effectors
  Description: MG81-357 effector
MVDLKKQLCSSASNSENQGVRFQTVVLYTKFVHKSVQLSPESSVFAVALFVRMMYNTKYQAKRGDPVGEKKNNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2080 - protein, 511 aa, Unknown
  Description of Unknown: uncultivated organism sequence
  Category: MG81 effectors
  Description: MG81-358 effector
MKKSNTDTCCLTLPLKLEKWQEDRLAKRFEIARQIYNTMVHAELKKLRNIENSQPYRQIQKQIEALNWKNQNDKAQLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2081 - protein, 512 aa, Unknown
  Description of Unknown: uncultivated organism sequence
  Category: MG81 effectors
  Description: MG81-359 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2082 - protein, 538 aa, Unknown
  Description of Unknown: uncultivated organism sequence
  Category: MG81 effectors
  Description: MG81-360 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2083 - protein, 397 aa, Unknown
  Description of Unknown: uncultivated organism sequence
  Category: MG81 effectors
  Description: MG81-361 effector
MAKCSTDTCCLTLPLRLEKWQEDRLAKRFEIARQIYNTMVRAELKKLRAMEQSEPYKANQEKIQALDWKTQADKQALKALYKERDKLLRDGGFSEYGFKSDIKNYYKHFNNNIGSSVAVHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKPEKSKGKRGSGNPSLTKLQPR

SEQ ID NO: 2084 - protein, 335 aa, Unknown
  Description of Unknown: uncultivated organism sequence
  Category: MG81 effectors
  Description: MG81-362 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEI

SEQ ID NO: 2085 - protein, 512 aa, Unknown
  Description of Unknown: uncultivated organism sequence
  Category: MG81 effectors
  Description: MG81-363 effector
MPAKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVAPVKTNYEKEMVANNETKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2086 - protein, 512 aa, Unknown
  Description of Unknown: uncultivated organism sequence
  Category: MG81 effectors
  Description: MG81-364 effector
MPTKQKEGGNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRERRNISSYGIA

SEQ ID NO: 2087 - protein, 511 aa, Unknown
  Description of Unknown: uncultivated organism sequence
  Category: MG81 effectors
  Description: MG81-365 effector
MGKSSTDTCCLTLPLKLEKWQEDRLAKRFEIARQIYNTMVRAELKRLRQVEQSPQYRSNKKAIQALDWKNTADKPKLKTLYRERDKLLKGGGFTEYGFKSDIKNFYKHFVENIGSSVAVHGIAPQVWAAFERVLFKKEGKKVHFKKTGDIRSLRGYSVTGKSGGVEIIFRGSYIEWKGLNLPLKLSPDNAYETEMLSYRVKYVRILRKPGKTRDRWYAQLSLEGKPAIKRNPASGNPVHPVGQGAVGLDIGPQTLAYAAEKEANLVELADRVQNIEREKHLLQRKMDRSRRAANPDNYAENGTIRRGVKLTHNKSKRYLRLQRELCYLQHCQAETRKRQHTELANHLLSLGSCFYVEDMAWPSLTHRAKKTEISDKTGRIKRKKRFGKSIANKAPAALINILRTKCVSLGIPGVVEVPTSLKASQYNHQSKEYTPKPLSQRWNDMPDGSRIQRDLYSAFLLQHYDPQSGNFDQASLEADYPQFVQLHNQSIQRLLTVPKTPSSMGIRRSVS

SEQ ID NO: 2088 - protein, 512 aa, Unknown
  Description of Unknown: uncultivated organism sequence
  Category: MG81 effectors
  Description: MG81-366 effector
MKKSSTDTCCLTLPLKLEKWQEDRLAKRFEIARQLYNTLVHAELKRLAQVKQTAEYRENERKIRTLDWNDPGDQAKLKGLYKERRKSLKTAGFTDYSFTTDMGKYYKHFRDNIGSSVAVHGIAPQVWAAFDKVLFKKGGKKVHYKKPGEVNSVQGYSRTGKSGGTEIMFRGPYIEWKGLKLPLKVSPDNAYETDMLQRRVKLVRLVRRPGKRRDRWYAQLVLEGKPAIKADPVTGKAVRPIGSGPVGLDIGPQTLAYSAAGVAGLVELADRVQNIEQEKRCLQRKMDRSRRATNPDNYAEDGTIRRGVKLTHNKSKRYRRSQQELKYLQHRQAEMRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPSSMGIRRSIA

SEQ ID NO: 2089 - protein, 511 aa, Unknown
  Description of Unknown: uncultivated organism sequence
  Category: MG81 effectors
  Description: MG81-367 effector
MAKCSTDTCCLTLPLRLEKWQEDRLAKRFEIARQIYNTMVRAELKKLRAIEQSEPYKANQEKIQALDWKTQADKQALKALYKERDKLLRDGGFSEYGFKSDIKNYYKHFNNNIGSSVAVHGIAPQVWAAFEKMLFKKEGKKAHFKKKGDIRSLRGYSVAGKSGGVEMIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMAWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2090 - protein, 338 aa, Unknown
  Description of Unknown: uncultivated organism sequence
  Category: MG81 effectors
  Description: MG81-368 effector
MDYLAQPEIIDDKAVKILQDEACCISTYRPCYATLVPKFIRGKYRVYLHLVIEGKAKPKYDSSGKPRHKYGKGVVGADIGTQTVAYTSDTETGLKNLSERGNSIQKSERLERLYYRAMDRSRRATNPKNYNADGTIKKGKKKWTYSRHYKKLKAKHAELCRINAINRQLAINEDANHLRSLGDIFVTEPKNAARLMKRAKETTVNNKGRINRKKRFGKSVKNRCPGGFQTAVENKFKTSGGTYIEVPNNYRASQYDHTADDYIKKKLSDRMYKLTDGTLVQRDWYSSFLLYCYNYRTNDIDKKKCAAEFKKCYSMEKEFIEWIKANKIKVLNSGIKTA

SEQ ID NO: 2091 - protein, 528 aa, Unknown
  Description of Unknown: uncultivated organism sequence
  Category: MG81 effectors
  Description: MG81-369 effector
MILLTKNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAETGKPIHSVGKGNVGIDIGPQTIAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTVTSMGVRRSHS

SEQ ID NO: 2092 - protein, 530 aa, Unknown
  Description of Unknown: uncultivated organism sequence
  Category: MG81 effectors
  Description: MG81-370 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGREIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALREDYPNFVTMHDAEIHRLESLPKTVTSMGVRRSHS

SEQ ID NO: 2093 - protein, 519 aa, Unknown
  Description of Unknown: uncultivated organism sequence
  Category: MG81 effectors
  Description: MG81-371 effector
MIQPELKAYRRCSDRHVLVLETNLTYVEKCQIFHYADLVRKAGNELTGIMKKRYDQLVRTKRYRKLKSLYKRYKDADNKKALKDVCDQMKEMQKQYDVTWDYCRTSMIPIGKKYGIDAVFALTKAEDVFRGIEKCLYSDGETVHFKKRGDLPCIRAKQINRGIIMKQMNFKFKNIEFGVKIKDRYEQEEVNAILYYLKHAEFMDSIAANTYKETNICISTYRPCYVSIVCKKIRGKLRVYVHITIEGLSKPKQDRFGNVKHNKGKGIVGCDIGTQTIAYTTETKAGLKNLAERGSCIEVNERKERRIYRAMDRSRRAMNPDNYNEDGTIKKGKKKWVLSNRYKKLRTKHTELCRINATNRHLAINADVNELRSLGDIFVTETKNAKKLQKKAKTGKRKKRFGRSIKNRCPGYFQSQAKRKFRIYVEVPNDYKASQYDHTSDEYVKKSLSQRMYKLQDGTMVQRDLYSSFLLYCIDLSTNKIDKNKCIHEFEKQYKNQNETIEYIQMNQIKVMNSGIRVN

SEQ ID NO: 2094 - protein, 680 aa, Unknown
  Description of Unknown: uncultivated organism sequence
  Category: MG81 effectors
  Description: MG81-372 effector
MKKSSTDTCCLTLPLKLEKWQSDRLEKRFEIGRQIYNTVVRAELKKLQQVERTPQYREIEQKLKGAKQEEAKELWKKRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKLLLQRKLDRSRRATNPGNYNPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCESLNLEGVKKVDTAVKASQYNHQTDECKAKELKERWNIMPDGERIQRDLYSAFLLQHCKRGLPEYNRKKLQEAFGNELYRSLIVKHSKGTIRNLWNTIGRRFNAFPCCPKRLPAWASGESSANMKIRCGSHQQNRSIVRPGLSLMATKVALTAEEFRENSQRSIDLFNTEKLSTNSTHVRKKCILQFCAFLPLQSARSVWRQSLYPGDVEKVPQVAICTERVEAKEPASHGGRKRKSCNLHGACGGKARQGDPQRGQGGVAICTERVKAKYSHYAYSPLT

SEQ ID NO: 2095 - protein, 524 aa, Unknown
  Description of Unknown: uncultivated organism sequence
  Category: MG81 effectors
  Description: MG81-373 effector
MAKNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2096 - protein, 534 aa, Unknown
  Description of Unknown: uncultivated organism sequence
  Category: MG81 effectors
  Description: MG81-374 effector
MGWKSKGRGGTLVKKSSTDTCCLTLPLKLEKWQSDRLEKRFEIGRQIYNTVVRAELKKLQQVERTPQYREIEQKLKEAKQEEAKELWKTRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRSIS

SEQ ID NO: 2097 - protein, 537 aa, Unknown
  Description of Unknown: uncultivated organism sequence
  Category: MG81 effectors
  Description: MG81-375 effector
MIIDGGYKKLLKQFHKHSDRHILVIETDMPYSDILKVVALSDKIRKAGNELVGLMKKNYAQLLRTKRYRKLLFLYGNTEDKDKRKIYANQLNEMQKIYNVTWNYCRTSMIPIGKKYGIDAVFALTKAEDVWRGMEKCLYGNGNTVHFSKHGDLPCIRAKQISRGIPISVRNDKLQFKLGKTSFGIQVNDRFQQDEVNAVLSYLVEPEIMDNKAVNTLIEDAYCIDTYRPCYATLVPKMIRGKYRVYLHLTIEGKTKLKYDKHGNPRYKYGKGIIGADIGTQTVAYTSDTEVGLKNLSERGNSIQTSERKERLLYRAMDRSRRATNPQNFNEDGTVKKGRKTWKYSNHYKKLKTKHSELCRINAVNRQLAINEDANHLRGLGDTLVTEPKNASKLMKRAKETTVNSKGKFNKKKRFGKSIKNRCPSGFQTTVEKKFKTTGGTYIEVPNNYRASQYDHTVDDYIKKKLSDRLYKLQDGTEVQRDWYSSFLLYCYDYKIQNIDKNKCITEFDNCYKKEKALITWIKTHKIKVLNSGIKTA

SEQ ID NO: 2098 - protein, 511 aa, Unknown
  Description of Unknown: uncultivated organism sequence
  Category: MG81 effectors
  Description: MG81-376 effector
MGKSSTDTCCLTLPLKLEKWQEDRLAKRFEIARQIYNTMVRAELKKLDRVKQLPEYRKNQKEIQALDWKNSADKQRLKELYGNQRKILQKQGFTEYGFKSDSKDYYKHFIENIGSSVATHCIAPQVWNAFDKMLFQKDGKVVHFKRYGDVHSLKGGSVAHKSGGTEIMFRKTYIEWKGLKLPLKLSPNNAYEAEMLSYRVKYVRILRTRGKTKDRWYAQLSLEGKPAVKYDSNTGKPVHPVGRGAVGLDIGPQTLAYAAANEANLVELADQVQNIEQEKRRLQRKLDRSRRATNPDNYNENGTIRQGVKLTHNKSKRYCKLQKELSWIQHCQAETRKRQHIALANHLLSLGDCFYVEPMAWPSLTHRAKKTEVSEKTGRIKRKKRFGKSVANKAPASLIGILKLKCISLGLTGVVEVPMLLKASQYNHQSKDYAKKSLSQRWNDMPDGNRIQRDLYSAFLLQHYNSQSESFDQETLERDYPQFVRLHNQTIQRLSALPKTPSSMGIRRSVS

SEQ ID NO: 2099 - protein, 353 aa, Unknown
  Description of Unknown: uncultivated organism sequence
  Category: MG81 effectors
  Description: MG81-377 effector
MSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLKQKCKSLELDVVMVNTSLKASQYNHQTGKYEKKTLSQRWNHMPDGEQIQRDLYSAFLLQHVVPEKNAFDNEALCREYPKFVQYHHEVIERLRSLPKTISSMGIRRSVS

SEQ ID NO: 2100 - protein, 512 aa, Unknown
  Description of Unknown: uncultivated organism sequence
  Category: MG81 effectors
  Description: MG81-378 effector
MPTKQKEDSNRCVLTLPLLTEPWQEHIIEKRFKIIEHLKNQLISIELRKLKKLQRTKAYKNLIKQIESVPKSERTVLYKKRNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHHEVSTDRVGIDIGTQTIAIASDKSVKLLELADKVNKNHIKKCELQRKLDRSRRYTNPDRFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2101 - protein, 538 aa, Unknown
  Description of Unknown: uncultivated organism sequence
  Category: MG81 effectors
  Description: MG81-379 effector
MDNEEKEKDGATCCLTLPLKLEKWQSDHLEKRFEIARQLYNTLVHAELKKKCQVERMPEYQEIMKMIDAASNQKEKWALEKKRKAFLEENGFNRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKTHWYAQLALEGKPAVKRDSISGAPKHPVGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2102 - protein, 388 aa, Unknown
  Description of Unknown: uncultivated organism sequence
  Category: MG81 effectors
  Description: MG81-380 effector
MVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2103 - protein, 530 aa, Unknown
  Description of Unknown: uncultivated organism sequence
  Category: MG81 effectors
  Description: MG81-381 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLKASQYNHLSDTYEKKSLSERWNYMPISDGSDSSKTKRIQRDLYSAFLLQHTIPQPCSFDKEALREDYPNFVTMHDAEIHRLEYLPKTITSMGVRRSHS

SEQ ID NO: 2104 - protein, 561 aa, Unknown
  Description of Unknown: uncultivated organism sequence
  Category: MG81 effectors
  Description: MG81-382 effector
MSNLLFLLENEEKEKDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGTPVAKYDPISGAPKHPVGHGVVGIDIGTRTLAYSTDSEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2105 - protein, 522 aa, Unknown
  Description of Unknown: uncultivated organism sequence
  Category: MG81 effectors
  Description: MG81-383 effector
MKKSSTDTCCLTLPLKLEKWQSDRLEKRFEIGRQIYNTVVRAELKKLQQVERTPQYREIEQKLKGAKQEEAKELWKKRTQLLSKSGFSEYGFKSDMKYYYQHFKENIGSSVAVHGIASQVWTAFEKVLFSKDGKMVHFKKKGELSSLRGYSQAGKSGGVEIIFRGSYVEWKGLKLPLKLSPDNDYETEMLSKRVKYVRILRNEGKTKPHWYAQLVLEGKPAIKRDPASGAPKHPVGHGAVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2106 - protein, 512 aa, Unknown
  Description of Unknown: uncultivated organism sequence
  Category: MG81 effectors
  Description: MG81-384 effector
MKKRSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIERKGLKLPLKLSPDNAYETDMLQRRVKLVRLVRRPGKRRDRWYAQLVLEAKPAIKADPVTGKAVHPIGSGPIGLDIGPQTLAYSAAGAAGLVGLADRVQNIEQEKRRLQRKMDRSRRAANPDNYAEDGTIRRGVKLTHYKSKRYRRSQQELKYLQHRQAEIRKLQHIQFANHLLSLGDHFYVEKMEWSSLTHRAKETVISEKTGKPRSKRRFGKSIANKAPAMLIEILRQKCKSLGLSDVVEINPADIKASQYNHLTGKYVKKSLSRRWNDMQDGEHLQRDLYSAFLLQHYDSCSKTLDHDSIVRDYPAFVQYHHREIERLHALPKTPSSMGIRRSIA

SEQ ID NO: 2107 - protein, 524 aa, Unknown
  Description of Unknown: uncultivated organism sequence
  Category: MG81 effectors
  Description: MG81-385 effector
MAKNNNTDTCVLTLPLRVEKWQEDCLLKRFEAARRIYNSLLNFELKKLRQLERTVEYRQIQSVISSAYRSNTKDSLECKDAFKRREKLISANGISENGFKSDVKFFYKYFDGLIGSSVAVHCIAVQLWAAFDKYLSGSGKEIHFKRLGDISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTITSMGVRRSHS

SEQ ID NO: 2108 - protein, 511 aa, Unknown
  Description of Unknown: uncultivated organism sequence
  Category: MG81 effectors
  Description: MG81-386 effector
MAKCSTDTCCLTLPLRLEKWQEDRLAKRFEIARQIYNTMVRAELKKLRAMEQSEPYKANQEKIQALDWKTQADKQALKALYKERDKLLRDGGFSEYGFKSDIKNYYKHFNNNIGSSVAVHGIAPQVWAAFEKMLFKKEGKKVHFKKKGDIHSLRGYSVTGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIEILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKAPSSMGIKRSLR

SEQ ID NO: 2109 - protein, 511 aa, Unknown
  Description of Unknown: uncultivated organism sequence
  Category: MG81 effectors
  Description: MG81-387 effector
MREDSQNTCCLTLPLKIEKWQADRLIKRFEIARQIYNTLVHAELKKLQKMEASAEYRKIQDRIRELNPSDVRAKKEWKILKDKQEKLWKAWKITEYGFKSDIKAYYKYFNENIGSAVATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLEQKCKSLELDVVMVNTSLKASQYNHQTGKYEKKTLSQRWNHMPDGEQIQRDLYSAFLLQHVVPEKNAFDNEALCRDYPKFVQYHHEVIERLRSLPKTISCMGIRRSVS

SEQ ID NO: 2110 - protein, 534 aa, Unknown
  Description of Unknown: uncultivated organism sequence
  Category: MG81 effectors
  Description: MG81-388 effector
MGWKSKGRGGTLVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTWIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2111 - protein, 538 aa, Unknown
  Description of Unknown: uncultivated organism sequence
  Category: MG81 effectors
  Description: MG81-389 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLAHRANKTEISEKKGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2112 - protein, 463 aa, Unknown
  Description of Unknown: uncultivated organism sequence
  Category: MG81 effectors
  Description: MG81-390 effector
MNNEEKEKDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRKDGKTKPHWYAQLVLEGKPAIKRDPASGAPKHPIGHGVVGIDIGTRTLAYSADSKVDLIELADRVQNIEQEKLLLQRKLDRSRRATNPENYKPDGTIKKGVKLTWNNSKRYKRIQHQYAMIQHHQADIRKQQHNELANYLLTLGDCFFVEDMDYRALTRKAKKTEISEKTGRYKRKKRFGKSIANKAPSMLITLLDQKCKSLNLEGVKKVDTAVKASQYNHQTDECKAKELKERWNIMPDGERIQRDL

SEQ ID NO: 2113 - protein, 388 aa, Unknown
  Description of Unknown: uncultivated organism sequence
  Category: MG81 effectors
  Description: MG81-391 effector
MVHFKKKGELSSLRGYSQAGKSGGIEIIFRGSYVEWKGLKLPLKLSSNNDYETEMLSKRVKYVRILRQDGKTKPHWYAQLVLEGKPAVKRDPISGAPKHPIGHGAVGIDIGTRTLAYSADSKVDLIELADRVQNIEQEKLLLQRKLDRSRRATNPENYKPDGTIKKGVKLTRNKSKRYRKIQHQLAMLQHRQANIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQEAFGNELYRVFDREALQRDYPKFVEYHRETIQRLSALPKTIASMGIRRIIS

SEQ ID NO: 2114 - protein, 508 aa, Unknown
  Description of Unknown: uncultivated organism sequence
  Category: MG81 effectors
  Description: MG81-392 effector
MADKECCVLTLPLQTEIWQEHIIEKRFAIMEHLKNQLIAKELRRLKNLERTKEYRNLIDEINNTPKEKRKALFSKRRKLLKDSGFSEYDFKDDIAGKNSLMQKHFIEHIATQIAHKLASDVWRSFDKFLFGNGRFIHFSKRGSLRSVASQKNGNGMTYKNGYFIWSGGQSKNKIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2115 - protein, 516 aa, Unknown
  Description of Unknown: uncultivated organism sequence
  Category: MG81 effectors
  Description: MG81-393 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLDRRVKYVRLLRKPGKRKDCWYAQLSLKGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDPKAGNFDSVLLQQDYPQFVQYHHRAIQRLSTVPKHSPAWEFKEVFDSAKII

SEQ ID NO: 2116 - protein, 508 aa, Unknown
  Description of Unknown: uncultivated organism sequence
  Category: MG81 effectors
  Description: MG81-394 effector
MADKECCVLTLPLQTEIWQEHIIEKRFAIMEHLKNQLIAKELRRLKNLERTKEYRNLIDEINNTPKEKRKALFSKRRKLLKDSGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2117 - protein, 524 aa, Unknown
  Description of Unknown: uncultivated organism sequence
  Category: MG81 effectors
  Description: MG81-395 effector
MAKNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLKASQYNHLSDTYEKKSLSERWNYMPISDGSDSSKTKRIQRDLYSAFLLQHTIPQPCSFDKEALREDYPNFVTMHDAEIHRLEYLPKTITSMGVRRSHS

SEQ ID NO: 2118 - protein, 511 aa, Unknown
  Description of Unknown: uncultivated organism sequence
  Category: MG81 effectors
  Description: MG81-396 effector
MSKRNTTDTCCLTLPLKLEKWQEDRLSKRFEIARQIYNTLVHAELKKLRQVEQSAEYRQIQVQLREMYQNNTTKTKEFRDIANHRRKLLDAAGFREYDFKSAIKDYYKYFKENIGSNVAIHGIAPLVWTAFENKLYKNGKKVHYKRPGDIYSLRGYSVTGKSGGSEIMFRGTYVEWKGLKLPIKRLPDNDYETAMLEYRVKYVRILRKPGKHKNYWYAQLSLEGKPVIKMNPVSNEPVHPIGSGAVGIDIGPQTIAYASQSEAGLLELASQVQNIERQKGLLQRKMERSRRDMNPENYMPDGTFRRGVKLTKNKSKHYCKLQRELAYLQHRQAETRKRQHIELANHLLSLGDCFYVEDMKWLSLTHRAKETEISEKTGRIKRKKRFGKSIANKAPATLIGILDTKCKSLGIPGVVKVPTIIKASQYNHQSDTYEKKPLGQRWNDMPSGERIQRDLYSAFLLQHLEPDLTGYNKKMLAQDYPQFVEYHNHVINDLSMKPKTLASMGIRRRVS

SEQ ID NO: 2119 - protein, 1355 aa, Unknown
  Description of Unknown: uncultivated organism sequence
  Category: MG81 effectors
  Description: MG81-397 effector
MKISKIKNSRPGISVAENKNEEPLSRQSLLYYAPVKDGKIRLESKDLEQHVTECNEKAQKLYNVITPEINFYRDENRQKMVENLAKNFNAVINNALRSIRNPKEKKEQRVEKEVAFILNLSKKSIKMKKDVFVKSTDLIVKFPENNKYNKKNDKGTGSKEADIQRIISDLVLRKLKKTLRKEVKLENGYRMQMTEITISLMSAICLYGNAESFDPAILKAFFEKVDSDYTKYKYVEQIVKSIESQSAKLKVIEKDGRHLLISANADHRKKKYVFEFMRMYAAADEKEKRELTEHIQDLIGLYLCGKAGYENAENRFSDMIESHNCICGKIEEILNELEKPENLSQQKKENLKNTTVKVMALKYRAAVNYLADEVGKTVLGEIREKKVRSCADLYWIEYIDSTVEKLLLKSRNKKRYRYEIGFLSKHIWKEWTQYISGKYIEIGKGVYHFAIPDLSGALEGESVSICEVKPEYRNGVSGFDYERIRAEESLEREMEKYVLFAVNNFARAVTPEEEREKSGHEDVLLMKTLSEIEESQTKEERQKKHDNNVKNAITLYADADRRILQFFGGQSRFREKEDSLINLYSGEDLYKEIRKELYAIRNITFHYTTKAEKDQTQKHDLAEYLFEEEFSDITELFREKYYANNVWKYYDAEVINTIMENIYCGRKYRAAQVPAFKNIISRPELPQVMNGFVKGNSLRRLMNCPDRDVINKYWSALFFVLKELYYYDFLQEQKKPEDNVKERFFRAIKKLSGQEKDDEKQKAWESFGNRIDQIGRDRSFGAICQGLMIEYMLQNSDISMVQTETDNGKANNKKQIYKHYRTLLYNCISEAFIEYLREKWKELRTPVLTAKEWSKEEFCRVDGLKHLSLFDHLKETFNDAESGSSWYMAAHFINQKYLNHLLGSIRNYLQFTEDIEDRAISLGDCVDNKREEKNLRYRNTLEILEFVAQFCERTTNVMEDYFESNQEYAEYLSDFVDYNTTKKETDIEKALYSFCKQKFKVDGKEYMAGIYYDGENLIPNRNIIRANMYGNTSCLKPCMDRITLKEIRTMYADQNKLDLVLKEGVCHTEEEQKAYREYQNEKNRIELFDVCTYTQILNDMQARLIGWSYMRERDLMYYQLGYYYTKLFWTDSISEEDARRRLVGNLVNVEDGAILYQILAFNSYNLPIIANKNNTVTLLKDEGSIGGKAITAFFKNYENAEMIYKEALDLFENMDEHAAIINTRNYIEHFKYFIKSDRSMMDLYSEIYDRFFRHDHNRKKNVPDSLKNVLADNFMIVDIDMELGSKKVGEKKKGFREHKAARIEFTDSGIRSTDMTYTIKPDIKDNKKVLVPARSEVFLKQFRKILEYRIQDKTQ

SEQ ID NO: 2120 - protein, 529 aa, Unknown
  Description of Unknown: uncultivated organism sequence
  Category: MG81 effectors
  Description: MG81-398 effector
MILLANNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2121 - protein, 508 aa, Unknown
  Description of Unknown: uncultivated organism sequence
  Category: MG81 effectors
  Description: MG81-399 effector
MADKECCVLTLPLQTEIWQEHIIEKRFAIMEHLKNQLIAKELRRLKNLERTKEYRNLIDEINNTPKEKRKALFSKRRKLLKDSGFSEYDFKDDIAGKNSLMQKHFIEHIATQIAHKLASDVWRSFDKFLFGNGRFIHFSKRGSLRSVASQKNGNGMTYKNGYFIWNGGQSKNKIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILGSKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2122 - protein, 511 aa, Unknown
  Description of Unknown: uncultivated organism sequence
  Category: MG81 effectors
  Description: MG81-400 effector
MGKSSTDTCCLTLPLKLEKWQEDRLAKRFEIARQIYNTMVRAELKKLDRVKQLPEYRKNQKEIQALDWKNSADKQRLKELYGNQRKILQKQGFTEYGFKADSKDYYKHFIENIGSSVATHGIAPQVWNAFDKMLFQKDGKVVHFKRYGDVHSLKGGSVAHKSGGAEIMFRKTYIEWKGLKLPLKLSPDNAYEAEMLSYHVKYVRILRTRGKTKDRWYAQLSLEGKPAVKYDSNTGKPVHPVGKGAVGLDIGPQTLAYVAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEETGRIKRKKRFGKSVANKAPASLIGILKLKCISLGLTGVVEVPMLLRASQYNHQSKDYAKKSLSQRWNDMPDGNRIQRDLYSAFLLQHYDSQSESFDQETLERDYPQFVRLHNQTIQRLSALPKTPSSMGIRRSVS

SEQ ID NO: 2123 - protein, 522 aa, Unknown
  Description of Unknown: uncultivated organism sequence
  Category: MG81 effectors
  Description: MG81-401 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNVMPDGERIQRDLYSAFLLQHCRRDLPEYNRKELQKEFGEELYRVFDREALQRDYPRFVAYHHMTIQRLSELPHTIPSMGIRRIIS

SEQ ID NO: 2124 - protein, 546 aa, Unknown
  Description of Unknown: uncultivated organism sequence
  Category: MG81 effectors
  Description: MG81-402 effector
MGWKSTGRGGKRVKRSSTDTCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIASMGIRRSIS

SEQ ID NO: 2125 - protein, 566 aa, Unknown
  Description of Unknown: uncultivated organism sequence
  Category: MG81 effectors
  Description: MG81-403 effector
MGWKSKGRGGKRVDNEEKEKDGATCCLTLPLKLEKWQSDHLEKRFEIARQLYNTLVHAELKRIHRIERMPEYREIERQIEATTDKKEKWALKNQKKQFLRKNGINRNTFTTDMKRFYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNIMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2126 - protein, 534 aa, Unknown
  Description of Unknown: uncultivated organism sequence
  Category: MG81 effectors
  Description: MG81-404 effector
MGWKSKGRGGKRVKKSSTDTCCLTLPLKLEKWQSDRLEKRFEIGRQIYNTVVRAELKKLHQVERTPQYREIEQKLKEAKQEEAKELWKKRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSSNNDYETEMLSRRVKYVRILRQDGKTKPHWYAQLVLEGKPAVKRDPISGASKHPIGHGAVGIDIGTRTLAYSADSKVDLIELADRVQNIEQEKLLLQRKLDRSRRATNPENYKPDGTIKKGVKLTRNKSKRYRKIQHQLAMLQHRQANIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQEAFGNELYRVFDREALQRDYPKFVEYHRETIQRLSALPKTIASMGIRRIIS

SEQ ID NO: 2127 - protein, 511 aa, Unknown
  Description of Unknown: uncultivated organism sequence
  Category: MG81 effectors
  Description: MG81-405 effector
MKKSNTDTCCLTLPLKLEKWQEDRLAKRFEIARQIYNTMVHAELKKLRNVENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPNNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2128 - protein, 538 aa, Unknown
  Description of Unknown: uncultivated organism sequence
  Category: MG81 effectors
  Description: MG81-406 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIASMGIRRSIS

SEQ ID NO: 2129 - protein, 336 aa, Unknown
  Description of Unknown: uncultivated organism sequence
  Category: MG81 effectors
  Description: MG81-407 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQPASAS

SEQ ID NO: 2130 - protein, 522 aa, Unknown
  Description of Unknown: uncultivated organism sequence
  Category: MG81 effectors
  Description: MG81-408 effector
MKKSSTDTCCLTLPLKLEKWQSDRLEKRFEIGRQIYNTVVRAELKKLHQLERTPQYREIEQKLKEAKQEEAKELWKKRTQLLSQSGFSEYGFKSDMKYYYQHFKENIGSSVAVHGIASQVWTAFEKVLFSKDGKMVHFKKKGELSSLRGYSQAGKSGGVEIIFRGSYVEWKGLKLPLKLSPNNDYETEMLSKRVKYVRILRQEGKTKPHWYAQLVLEGKPAIKRDPASGAPKHPVGHGVVGLDIGTRTLAYSADDKVDLLELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKELQKEFGEELYRVFDREALQRDYPQFVVYHHMTIQRLSALPKTIASMGIRRIIS

SEQ ID NO: 2131 - protein, 538 aa, Unknown
  Description of Unknown: uncultivated organism sequence
  Category: MG81 effectors
  Description: MG81-409 effector
MDNEGKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISGAPKHPVGHGVVGIDIGTRTLAYSTDKEVNLLELADRVQNIEQEKRRLQRKMDRSRRATNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNIMPDGERIQRDLYSAFLLQHCKQGLLEYNRKELKKEFGEELYRVFDREALQRDYPQFVAYHHMTIQRLSELPHTIPSMGIRRIIS

SEQ ID NO: 2132 - protein, 554 aa, Unknown
  Description of Unknown: uncultivated organism sequence
  Category: MG81 effectors
  Description: MG81-410 effector
MNNEEKEKDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGKEIMFRNGKIIWTQQENDDRKKSPKYQQRKKRQNYKGVKGIAREFPVVFSKNNPYEAEMLTKHVKFVRILRKDGKTKPHWYAQLVLEGTPVAKYDPISGAPKHPVGHGAVGIDIGTRTLAYSADSKVDLIELADRVQNIEQEKLLLQRKLDRSRRATNPGNYNPDGTIKCGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQETFGNELYRVFDREALQRDYPKFVEYHRKTIQRLSALPKTIASMGIRRIIS

SEQ ID NO: 2133 - protein, 522 aa, Unknown
  Description of Unknown: uncultivated organism sequence
  Category: MG81 effectors
  Description: MG81-411 effector
MKRSSTDTCCLTLPLKLEKWQSDRLEKRFEIGRQIYNTVVRAELKKLQQVERTPQYREIEQKLKGAKQEEAKELWKKRTQLLSKSGFSEYGFKSDMKYYYQHFKENIGSSVAVHGIASQVWTAFEKVLFSKDGKMVHFKKKGELSSLRGYSQAGKSGGVEIIFRGSYVEWKGLKLPLKLSPDNDYETEMLSKRVKYVRILRQDGKTKPHWYAQLVLEGKPAIKRDPASGAPKHPVGHGVVGIDIGTRTLAYSADSKVDLIELADRVQNIEQEKLLLQRKLDRSRRATNPENYKPDGTIKKGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRIFDREALQRDYPKFVEYHRETIQRLSALPKTIASMGIRRSIS

SEQ ID NO: 2134 - protein, 511 aa, Unknown
  Description of Unknown: uncultivated organism sequence
  Category: MG81 effectors
  Description: MG81-412 effector
MGKSKTETCCLTLPLKLEKWQEDRLAKRFEIARQIYNTLVHAELKKLNQIERSSEYQTIQDQITNLDRNDPERIKELPSLYKKRTKLLRDAGFTEYGFKSDVKHYYKYFHKNIGSSVAVHGIAPQVWAAFEKKLFKKQGKIVHYKRKGTLRSVKGGSATGKSGGTEIIFRGTYIQWKDLNLPLKRSPDNAYESEMLGYRVKYVRILRKPGKSKNRWYAQLVLEGKPVIKRNPMTGAALHPVGHGAVGLDIGPQTLAYSAADGVGLLELADQVQNIERQKALLQRKLDRSRRASNPDNYNEDGTIKRGVKLTRNQSKRYCKTQRDLAYLQHCQAETRKRQHIALANHLLTLGDRFYVEQMSWVALARRSKKTEVSEKTGKIKRKKRFGKSIANKAPAMLIEILRQKCISLGLPGVVDVPTSIKASQYNHQSKDYIKKNLSERWNDMPDGEKIQRDLYSAFLLQHCTPELNAFDQESLQQDYPRFVQYHHQVMQQLSEMPKTPSSMGIRRRTS

SEQ ID NO: 2135 - protein, 534 aa, Unknown
  Description of Unknown: uncultivated organism sequence
  Category: MG81 effectors
  Description: MG81-413 effector
MGWKSKGRGGTLVKKSSTDTCCLTLPLKLEKWQSDRLEKRFEIGRQIYNTVVRAELKKLQQVERTPQYREIEQKLKEAKQEEAKELWKTRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRSIS

SEQ ID NO: 2136 - protein, 508 aa, Unknown
  Description of Unknown: uncultivated organism sequence
  Category: MG81 effectors
  Description: MG81-414 effector
MADKECCVLTLPLQTENWQEHIIEKRFAIMEHLKNQLIAKELRRLKNLERTKEYRILIDEINNTPKEKRKALFSKRRKLLKDSGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKGNAGIDIGTQTVAISSADSVKLLELADKIDKNHTKKKILQRKMDRSRRYTNPQNYNEDGTIKKPPKGQRYCWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLEHCNREKCNETYSNFKVLQDKEIERLYSDIRKGNCKNISSFGFQRNAKAM

SEQ ID NO: 2137 - protein, 508 aa, Unknown
  Description of Unknown: uncultivated organism sequence
  Category: MG81 effectors
  Description: MG81-415 effector
MADKECCVLTLPLQTEIWQEHIIEKRFAIMEHLKNQLIAKELRRLKNLERTKEYRNLIDEINNTPKEKRKALFSKRRKLLKDNGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLNILESKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2138 - protein, 511 aa, Unknown
  Description of Unknown: uncultivated organism sequence
  Category: MG81 effectors
  Description: MG81-416 effector
MLVSKRSTTDTCCLTLPLRLEKWQADRLAKRFEIARQIYNTLVRAELKKLVRLERISAYKDIQQQLYSLYRDGHQNSREYKVLFQKRRSLLTEAGIREYGFKSDIAKYYKHFHENIGSSVAVHCIASQVWCAFDKYLFHNGKQVHFKRAGDIRSLKGYSVSGKSGGTEIIYRGTFIEWKGLRLPLKLDPDNRYEAEMLTKRVKYVRLLRTRGNHQDRWYAQLVLEGTPAVKHDAKTNALRHPIGHGAVGIDIGPQTIAYVAQDEAALMELANRVQNIEREKLLIQRKMDRSRRATNPDNYAVDGTIKRGVKLTRNKSKRYCTLQHRLAFIQSRQALIRKVQHTELANHLLSLGDRFYVENMEWSSLTHRASETAISEKTGRYKRKKRFGKSISNKAPATLIGILEQKCKSLGLPGVIKVPTKLCASQYNHMTDTREKKPLSQRWNDMPDGHRIQRDLYSAFLLQHVTPQEDGFDRPSLQRDYEKFVSLHDEVIRQLTLAPKTLSSMGIRRT

SEQ ID NO: 2139 - protein, 1358 aa, Unknown
  Description of Unknown: uncultivated organism sequence
  Category: MG81 effectors
  Description: MG81-417 effector
MKISKIKNSRPGISVAENKNEESLSRQSLLYYAPVKDGKIRLESKDLEQHVTECNEKAQKLYNVITPEINFYRDENRQKMVENLARNFNAVINNALRSIRNPKEKKEQRVEKEVAFILNLSKKSIKMKKDVFVKSTDLIVKFPENNKYNKKNDKGTGSKEAYIQKMISDLVLRKLKNTLRKEVKLENGYRMQMTEIIISLMSAICLYGNAESFDPAILKAFFEKVDSDYTKYKYVEQIVKSIESQSAKLKVVEKDGRHLLISANADHRKKKYVFEFMRMYAAADEKEKRELTEHIQDLIGLYLCGKAGYENAENRFSDMTESHNCICGKIEEILNELEKPENLSQKKKENLKNTTVKVMALKYRAAVNYLADEVGKTVLGEIREKKVRSCADLYWIEYIDSTVEKLLLKSRNKDGYRYEIGFLSKHIWKEWTQYISGKYIEMGKGVYHFAIPDLSGNLEGEPISICEVKPEYRNGVSGFDYERIRAEESLEREMEKYVLFAVNNFARAVTPEEEREKSGHEDVLLMKTLSEIEESQTKEERQKKHDNNVKNAITLYADADRRILQFFGGQSRFREKEDSLINLYSGEDLYKEIRKELYAIRNITFHYTTKADKDQTQKHDLAEYLFEEEFSDITELFREKYYANNVWKYYDVEVINTIMENIYCGRKYRAAQVPAFKNIISRPELPQVMNGFVKGNSLRRLMNCPDRDVINKYWSALFFVLKELYYYDFLQEQKKPEDNVKERFFRAIEKLSGQENDDKKQKAWESFGNRIDQIGRDRSFGAICQGLMIEYMLQNSDISMVQTETDNGKANNKKQIYKHYRTLLYNCIREAFIEYLREKWEELRTPVLTVKEWSKEEFCRADGLKHLSLFDHLKKTFNDAESGSSWYMAAHFINQKYLNHLLGSIRNYLQFTEDIEDRAISLGDCVDNKREEKNLRYRNTLEILEFVAQFCERTTNVMEDYFESNQEYAEYLSGFVDYNTTKKETDIEKALYSFCKQKFKVDGKEYMAGIYYDGENLIPNRNIIRANMYGNTSCLKPCMDRITLKEIRTMYADQNKLDLVLKEGVCHTEEEQKAYREYQNEKNRIELFDVCTYTQILNDMQARLIGWSYMRERDLMYYQLGYYYTKLFWTDSISEEDARRRLVGNLVNVEDGAILYQILAFNSYNLPIIANKNNTVTLLKDEGSIGGKAITAFFKNYENAEMIYEEALDLFENMDEHAAIINTRNYIEHFKYFIKSDRSMMDLYSEIYDRFFRHDHNRKKNVPDSLKNVLADNFMIVDIDMELGSKKVGEKKKGFREHKAARIEFTDSGIRSTDMTYTIKPDIKDNKKDKKVLVPARSEVFLKQFRKILEYRIQDKIQ

SEQ ID NO: 2140 - protein, 530 aa, Unknown
  Description of Unknown: uncultivated organism sequence
  Category: MG81 effectors
  Description: MG81-418 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLRASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2141 - protein, 322 aa, Unknown
  Description of Unknown: uncultivated organism sequence
  Category: MG81 effectors
  Description: MG81-419 effector
MCNEINMISWQKFQRPMSGFDLGYSAKGMSKMMAIPQRSIGCICTEYATRTKQFKKRKLNWRSYKKNTGWIPFATQQMKCFSDGIFFNGQKFKLWDYKPFDEKTIKSGSFQQDARGRWYVSITVEIEASSEIPKTGKAVGIDLGLKSLVTLSDGTVYDRVNLTEMYAKKLATAQLAGNLMQVRNIHAKIKNTRKNFYHEISLAIVKNYDEIYIGNISSSKLIKTKMAKSVSDAAWYDFKFMLKYKAERAGKKFVEVNESFSTVTCSSCLERTGPSGLSALGVRSWICSHCGAAHDRDVNAAKNILRSGQCADLRVKGSSLKN

SEQ ID NO: 2142 - protein, 384 aa, Unknown
  Description of Unknown: uncultivated organism sequence
  Category: MG81 effectors
  Description: MG81-420 effector
MVHFKKKGELSSLRGYSQTGKSGGIEIIFRGSYVEWKGLKLPLKLSPDNDYETEMLSKRVKYVRILRQDGKTKPHWYAQLVLEGKPAVKRDPISGAPKHPIGRGVVGIDIGTRTLAYSADSKVDLIELADRVQNIEQEKLLLQRKLDRSRRATNPENYKPDGTIKKGVKLTRNKSKRYRRIQHQLAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIS

SEQ ID NO: 2143 - protein, 538 aa, Unknown
  Description of Unknown: uncultivated organism sequence
  Category: MG81 effectors
  Description: MG81-421 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2144 - protein, 495 aa, Unknown
  Description of Unknown: uncultivated organism sequence
  Category: MG81 effectors
  Description: MG81-422 effector
MPNTDSNRCILTLPLMTEPWQEHLIETRFDIMEHLKNSLIALELRKLKNLQRTRAYKELEKKIFEKPKEERKPLYKERSAMLRTAGFSEFDFINDMTPMQKHFADHIAAQISHRSASDVWRAFESYLFSSGREVHFQKRGTLDSVACKKAGNGMNYRNDTFEWSGGRTPNAKRLCIRVENPQTEYEKHMLEKEVKNMRIIRKWMKTRYKYYLQLTLVGDPYQKPRKIGEGRVGIDIGTRTIAIASETTVRLLELADRIDGNHKRKCELQRKMDASKRATNPDNFNSDGTIRRRSKGKKMTWHFSKHYLRMRDQVRELERKNADIRTYQHNCLANEVLTLGTDVFVEPMSYKGLQHRAKETKVDEKGRYLKKKRFGKSLANKAPSKFLMILENKLACKGKALNYVDINRFRASQFDHTNGTYRKKQLSERFATLSTGEHVQRDMYSAFLLMNSNDSLNAPDIERCGQTFERFKELHAIEVERIRQSPYRRIQSFGI

SEQ ID NO: 2145 - protein, 508 aa, Unknown
  Description of Unknown: uncultivated organism sequence
  Category: MG81 effectors
  Description: MG81-423 effector
MADKECCVLTLPLQTEIWQEHIIEKRFAIMEHLKNQLIAKELRRLKNLERTKEYRNLIDEINNTPKEKRKALFSKRRKLLKDSGFSEYDFKDDIAGKNSLMQKHFIEHIATQIAHKLASDVWRSFDKFLFGNGRFIHFSKRGSLRSVASQKNGNGMTYKNGYFIWSGGQSKNKIILKIKVTPPKNEYEKEMLSKKIKYLRIVKKWVKTRYKYYLQFALEGKPVKKDRIVNKGNVGIDIGTQTVAISSADSVKLLELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLEHCNREKCNETYSNFKVLQDKEIERLYSDIRKGNCKNISSFGFQRNAKAM

SEQ ID NO: 2146 - protein, 528 aa, Unknown
  Description of Unknown: uncultivated organism sequence
  Category: MG81 effectors
  Description: MG81-424 effector
MILLTKNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2147 - protein, 317 aa, Unknown
  Description of Unknown: uncultivated organism sequence
  Category: MG81 effectors
  Description: MG81-425 effector
MLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2148 - protein, 475 aa, Unknown
  Description of Unknown: uncultivated organism sequence
  Category: MG81 effectors
  Description: MG81-426 effector
MKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRSIS

SEQ ID NO: 2149 - protein, 526 aa, Unknown
  Description of Unknown: uncultivated organism sequence
  Category: MG81 effectors
  Description: MG81-427 effector
MAKNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATSPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLLGVVEVDTFRLRASQYNHLSDTYEKKSLSERWNYMPISDGSDRSKTKRIQRDLYSAFLLQHTIPQSCSFDKEALRIDYPNFVTMHDAEIHRLESLPKTITSMGVRRSHS

SEQ ID NO: 2150 - protein, 386 aa, Unknown
  Description of Unknown: uncultivated organism sequence
  Category: MG81 effectors
  Description: MG81-428 effector
MALRRRSGPFKKEGKKVHFKKTGDIRSLRGYSVTGKSGGVEIIFRGSYIEWKGLNLPLKLSPDNAYETEMLSYRVKYVRILRKPGKTRDRWYAQLSLEGKPAIKRNPASGNPVHPVGQGAVGLDIGPQTLAYAAEKEANLVELADRVQNIEREKHLLQRKMDRSRRAANPDNYAENGTIRRGVKLTHNKSKRYLRLQRELCYLQHCQAETRKRQHTELANHLLSLGSCFYVEDMAWPSLTHRAKKTEISDKTGRIKRKKRFGKSIANKAPAALINILRTKCVSLGIPGVVEVPTSLKASQYNHQSKEYTPKPLSQRWNDMPDGSRIQRDLYSAFLLQHYDPQSGNFDQASLEADYPQFVQLHNQSIQRLLTVPKTPSSMGIRRSVS

SEQ ID NO: 2151 - protein, 542 aa, Unknown
  Description of Unknown: uncultivated organism sequence
  Category: MG81 effectors
  Description: MG81-429 effector
MATTDKKDKDKEKLRAYKFRLDPNQAQTIALYQAAGAARYTYNMLTAYNLEVNRLRDDYWKKRHDEGISDADIKKELNALTKEDKRYKQLKYGAFGTQYLTPEKKRHEQAEHRIENGEDPSVVWNQETERSANPWLHTANQRVLVSGLKNASDAWDNFWASRTGKRAGRLVGTPRFKKKGVSRDSFTVPAPEKMGAYGTAYLRGEPAYKQGRRKITDYRHVRLSYLGTIRTFNSTKPLVKAVAAGAKIRRYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATEYTLVGFEDLNVSGMTASAKGTVENPGKNVAQKSGLNRVVLDAAFGVFRNQLEYKAVWYGSAFEKVDRYFASSQTCSECGRKAKTKLTLRDRVFDCAYCGNMMDRDLNAAVNICREAQRLFDEKLASEDGESLNGRGSRGALRGAETVEASRPPASHRRGSP

SEQ ID NO: 2152 - protein, 527 aa, Unknown
  Description of Unknown: uncultivated organism sequence
  Category: MG81 effectors
  Description: MG81-430 effector
MAKNNNNNDTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSSVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLKASQYNHLSDTYEKKSLSERWNYMPISDGSDSSKTKRIQRDLYSAFLLQHTIPQPCSFDKEALRIDYPNFVTMHDAEIHRLESLPKTITSMGVRRSHS

SEQ ID NO: 2153 - protein, 527 aa, Unknown
  Description of Unknown: uncultivated organism sequence
  Category: MG81 effectors
  Description: MG81-431 effector
MKALAVYNHHIERRDSYEKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2154 - protein, 536 aa, Unknown
  Description of Unknown: uncultivated organism sequence
  Category: MG81 effectors
  Description: MG81-432 effector
MDNEEKEKDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRKEGKTKSHWYAQLVLEGKPTVKRDPISGAPKHPVGHGVVGIDIGTRTLAYSTDSEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYDRKELKKEFGEELYRVFDREALQRDYPQFVAYHHMTIQRLSELPHTIPSMGIRRIIS

SEQ ID NO: 2155 - protein, 526 aa, Unknown
  Description of Unknown: uncultivated organism sequence
  Category: MG81 effectors
  Description: MG81-433 effector
MNNEEKEKDGATCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQAGKSGGIEIIFRGSYVEWKGLKLPLKLSPDNDYETEMLSKRVKYVRILRKDGKTKTHWYAQLALEGKPAVKRDSISGAPKHPVGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2156 - protein, 538 aa, Unknown
  Description of Unknown: uncultivated organism sequence
  Category: MG81 effectors
  Description: MG81-434 effector
MNNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2157 - protein, 548 aa, Unknown
  Description of Unknown: uncultivated organism sequence
  Category: MG81 effectors
  Description: MG81-435 effector
MEWKSTGRGGTLVDNEEKKEDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRNEGKTKPHWYAQLVLEGKPAIKRDPASGAPKHPVGHGVVGIDIGTRTLAYSTDSEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYDRKELKKEFGEELYRVFDREALQRDYPQFVAYHHMTIQRLSELPHTIPSMGIRRIIS

SEQ ID NO: 2158 - protein, 341 aa, Unknown
  Description of Unknown: uncultivated organism sequence
  Category: MG81 effectors
  Description: MG81-436 effector
MLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2159 - protein, 538 aa, Unknown
  Description of Unknown: uncultivated organism sequence
  Category: MG81 effectors
  Description: MG81-437 effector
MDNEEKKEDGATCCLTLPLKLEKWQSDHLEKRFEIARQLYNTLVHAELKKKCQVERMSEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2160 - protein, 522 aa, Unknown
  Description of Unknown: uncultivated organism sequence
  Category: MG81 effectors
  Description: MG81-438 effector
MKRSSTDTCCLTLPLKLEKWQSDRLEKRFEIGRQIYNTIVHAELKKLRKLERMQQYQEIEQKLENAKQEETKELWKKKRQLLDQNGLSEDHFKADMKYYYPHFKDNIASNVAVHGIASQAWTAFEKVLFSKDGKMVHFKKKGELSSLRGYSRAGKSGGVEIIFRGSYVEWKGLKLPLKLSPDNDYETEMLSKRVKYVRILRKDGKTKTHWYAQLVLEGKPTVKRDPISGAPKHPVEHGVVGIDIGTRTLAYSTDSEVNLLELADRVQNIEQEKRRLQRKMDRSRRAMNPENYNSDGPFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2161 - protein, 524 aa, Unknown
  Description of Unknown: uncultivated organism sequence
  Category: MG81 effectors
  Description: MG81-439 effector
MAKNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLKASQYNHLSDTYEKKSLSERWNYMPISDGSDSSKTKRIQRDLYSAFLLQHTIPQPCSFDKEALREDYPNFVTMHDAEIHRLESLPKTITSMGVRRSHS

SEQ ID NO: 2162 - protein, 511 aa, Unknown
  Description of Unknown: uncultivated organism sequence
  Category: MG81 effectors
  Description: MG81-441 effector
MKKSNTDTCCLTLPLKLEKWQEDRLAKRFEIARQLYNTLVHAELKRLAQVKQTAEYRENERKIRTLDRNNPADRAELSELYQKQKTMLDAKFRKSYFKKHMENYYKHFRDNIGSSVAVHGIAPQVWAAFDKVLFKKGGKKVHYKKPGEVNSVQGYSRTGKSGGREIMFRGAYIEWKGLKLPLKLSPDNAYETDMLQRRVKLVRLVRRPGKRRDRWYAQLVLEGKPAIKADPVTGKAVHPIGSGPIGLDIGPQTLAYSAAGAAGLVELADRVQNIEQEKRRLQRKMDRSRRATNPDNYAEDGTIRRGVKLTHYKSKRYRRRQQELKYLQHRQAEIRKLQHIQLANHLLSLGDHFYVEKMEWSSLTHRAKETVISEKTGKPRSKRRFGKSIANKAPAMLIEILRQKCKSLGLSDVVEITPADIKASQYNHLTGKYVKKSLSRRWNDMQDGEHLQRDLYSAFLLQHYDSCSKTLDLDSLARDYPAFVQYHHREIERLHALPKTPSSMGIRRSIA

SEQ ID NO: 2163 - protein, 508 aa, Unknown
  Description of Unknown: uncultivated organism sequence
  Category: MG81 effectors
  Description: MG81-442 effector
MADKECCVLTLPLQTEIWQEHIIEKRFAIMEHLKNQLIAKELRRLKNLERTKEYRNLIDEINNTPKEKRKALFSKRRKLLKDNGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKCNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2164 - protein, 578 aa, Unknown
  Description of Unknown: uncultivated organism sequence
  Category: MG81 effectors
  Description: MG81-443 effector
MAFGSKNSTPSFVLTLPMVIGLNEQDYLNKEFKKCGIIYNQLVNATTKMWHQLRKTRKYRELMAAIAKAAPDSDEQKALFKQREKMLKEYRFSEDAFHAMVVPYAKHYAINSHVAQSIATAVWTAWSSFFFDKGKGVHYKKLEYVSSISGKNNATGIMLRPANHTTSVINSAKTKAKNSIEKKYFAAYRKPDAKEGEEVVLPDEVKAQMEKEIAAATAKVKTSIGKGKLHITYGDYTFPVTLRNPDTQTGWYQQEALKCGVKYCRIIRKWVSTKWKYYAQIVLEGYPPIKCDNNGVAKHPVKQGRVGIDIGTQTIAFSGKDVCDLRVLAPAARAQAKSLVNEIASTLRAMDRSRRATNPKYYNPDGTIKRLKRQHGQKQKRKWKYSKRYYRLRAKLRNLYRKLADIRKMEHNILANELLANGNEFVVEDMNYKALQKRSKETKINPKTGRAYTKKRFGKSLSRCAPAMFISILGKKANRYGGSVIKVSTFETKASQFDHTDESYTKKKLSERMARLRSGDIVQRDLYSAFLLEHIDTESLQYNMETLNSVFPAFLEMHENTKRRLQAVGSSLPASIGF

SEQ ID NO: 2165 - protein, 508 aa, Unknown
  Description of Unknown: uncultivated organism sequence
  Category: MG81 effectors
  Description: MG81-444 effector
MADKECCVLTLPLQTEIWQEHIIEKRFAIMEHLKNQLIAKELRRLKNLERTKEYRNLIDEINNTPKEKRKALFSKRRKLLKDNGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2166 - protein, 508 aa, Unknown
  Description of Unknown: uncultivated organism sequence
  Category: MG81 effectors
  Description: MG81-445 effector
MADKECCVLTLPLQTEIWQEHIIEKRFAIMEHLKNQLIAKELRRLKNLERTKEYRNLIDEINNTPKEKRKALFSKRRKLLKDNGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYLAFLIMNSDISLKHCNREKCNETYSNFKVLQDKEIERLYSDIRKGNCKNISSFGFQRNAKAM

SEQ ID NO: 2167 - protein, 508 aa, Unknown
  Description of Unknown: uncultivated organism sequence
  Category: MG81 effectors
  Description: MG81-446 effector
MADKECCVLTLPLQTEIWQEHIIEKRFAIMEHLKNQLIAKELRRLKNLERTKEYRNLIDEINNTPKEKRKALFSKRRKLLKDNGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILGSKLNQYGGQLNKINTYEFKASQYDHTDDTFTKHNRSERWHILSNGDKNQRDLYSAFLIMNSDISLKHCNRKKCNETYSTFKVLQDKEIERLYSDIRKGNCKNISSFGFQRNAKAM

SEQ ID NO: 2168 - protein, 551 aa, Unknown
  Description of Unknown: uncultivated organism sequence
  Category: MG81 effectors
  Description: MG81-447 effector
MSNLLFLLENEEKMRYNGVEKQREGEGTRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLSEYNRKELKKEFGEELYRVFDREALQRDYPQFVAYHHMTIQRLSELPHTIPSMGIRRIIS

SEQ ID NO: 2169 - protein, 512 aa, Unknown
  Description of Unknown: uncultivated organism sequence
  Category: MG81 effectors
  Description: MG81-448 effector
MKKSSTDTCCLTLPLKLEKWQEDRLAKRFEIARQLYNTLVHAELKRLAQVKQTAEYRENERKIRTLDWNNPAHRTELEKLYEERRKSLKKAGFTDNSFTTDMGKYYKHFRDNIGSSVAVHGIAPQVWAAFDKLLFKKGGKKVHCKRPGEVNSVQGYSRTGKSGGREIMFRGAYIEWKGLKLPLKLSPDNAYETDMLQRRVKLVRLVRRPGKRRDRWYAQLVLEGKPAIKADPVTGKAVHPIGSGPVGLDIGPQTLAYSAAGVAGLVELADRVQNIEQEKRCLQRKMDRSRRATNPDNYAEDGTIRRGVKLTHNKSKRYRRNQQELKYLQHHQAEIRKLQHIQLANHLLSLGDHFYVEKMEWSSLTRRAKKTVISEKTGKPRSKKRFGKSIANKAPAMLIEILRQKCKSLGLPNVVEINPADIKASQYNHLTGEYVKKSLSRRWNDMQDGEHLQRDLYSAFLLQHYDSMSKALDLDSLARDYPAFVQYHHREIERLHALPKTPASMGIRRSIA

SEQ ID NO: 2170 - protein, 511 aa, Unknown
  Description of Unknown: uncultivated organism sequence
  Category: MG81 effectors
  Description: MG81-449 effector
MGKSSTDTCCLTLPLKLEKWQEDRLAKRFEIARQIYNTMVRAELKKLDRVKQLPEYRKNQKEIQALDGKNSADRARLKELRANQNRILQKQGFTKYGFKSDSKDYYKHFIENIGSSVATHGIAPQVWNAFDKMLFQKDGKVVHFKRYGDVHSLKGGSVAHKSGGAEIMFRKTYIEWKGLKLPLKLSPNNAYEAEMLSYRVKYVRILRTRGKTKDRWYAQLSLEGKPAVKYDSSTGKPVHPVGRGAVGLDIGPQTLAYVAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEETGRIKRKKRFGKSVANKAPASLIGILKLKCISLGLTGVVEVPMLLRASQYNHQSKDYAKKSLSQRWNDMPDGNRIQRDLYSAFLLQHYNSQSESFDQETLERDYPQFVRLHNQTIQRLSALPKTPSSMGIRRSVS

SEQ ID NO: 2171 - protein, 496 aa, Unknown
  Description of Unknown: uncultivated organism sequence
  Category: MG81 effectors
  Description: MG81-450 effector
MSEKKLGNTVLTLPLYPEKWQIDIIEKRFRIMELLKNALIAKELRRLRNLQRTRVWRRLEDEIRSTDKTERKKLYARRTELLRTAGFSKYGFYEDMEPMQKRYIVHIGAQVAQRASSDVWQAFEKMLYGNGDMVHFHKAGSLYSIANKKSGNCMIFRNGCLEWNGGQSRDAVKLILPSKARLTDYERQMLEKPIKYYRVIRKWMKTRWKYYVQITLAGETVHKDRPVGAGRVGIDIGTRTIAVAAEKAVFLRELADGVDENHRRKCALQRKMDNSRRSTNPENYNPDGTVRRPGKGHRPHWVKSRRYLKMQAMVRNLERKNADIRKYQHICLANEIIRLGTDVYVEQMSYSGLQRRAKETTYDDKGRAKKKKRFGKSLANKAPASFLLILNQKLSYLEPTGLKHVDTKAFRASQLDHTDQSYHSKKLGERWTVLSDGTKVQRDMYSAFLLMNSNAEMNGVDLEQCNQTFEHFKYMHDRAIETIRNDGKRHPASFGV

SEQ ID NO: 2172 - protein, 511 aa, Unknown
  Description of Unknown: uncultivated organism sequence
  Category: MG81 effectors
  Description: MG81-451 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLKGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDPKAGNFDSVLLQQDYPQFVQYHHRAIQRLSTVPKTLSSMGIQRSLR

SEQ ID NO: 2173 - protein, 530 aa, Unknown
  Description of Unknown: uncultivated organism sequence
  Category: MG81 effectors
  Description: MG81-452 effector
MILLANNNNNNNTDTCVLTLPLRVEKWQEDCLLKRFEAARRIYNSLLNFELKKLRQLERTVEYRQIQSVISNAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2174 - protein, 488 aa, Unknown
  Description of Unknown: uncultivated organism sequence
  Category: MG81 effectors
  Description: MG81-453 effector
MTNQEYNKLLKQYHKLSDRHILVAETDMPYSDVQKVVALSDKIRKAGNELVGLMRKNHDQLMRTKKYRKLLNLYGNTENKVHRKSLAKQLNEMQKAYNVTWDFCRTSMIPIGKKYGIDAVFALTKAEDVWRGMEKCLYGNGEMLHFSKYGELPCIRAKQINRGIPISIKDNKVQFKLGKIMFGLQIKDRFQTDEINSVMSYLANPEIMDTKAVDTFIEGARCIDTYRPCYATLVPKFIRGKYRVYLHLTIEGKAKPKYDKFGNPRHKYGKGIIGADIGTQTVAYTSDTEVGIKNLSERGNSIQDSERLERLYYRAMDRSRRATNPQNYNDNGTVKRGKKSWKYSNHYKKLRAKHSELCRINAVNRQLAINEDANHLRSLGDTIITEPKNASKLMLRVKKTTKNAKGKFNKKKRFGKSIKSRCPGGFQTTVKNKFKVSGGTYIEVPNNYRASQYDHTADEYIKKKLSDRLYKLRDGTLVQRDWYSSFLL

SEQ ID NO: 2175 - protein, 511 aa, Unknown
  Description of Unknown: uncultivated organism sequence
  Category: MG81 effectors
  Description: MG81-454 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIVPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2176 - protein, 338 aa, Unknown
  Description of Unknown: uncultivated organism sequence
  Category: MG81 effectors
  Description: MG81-455 effector
MGKSSTDTCCLTLPLKLEKWQEDRLAKRFEIARQIYNTMVRAELKRLRQVEQSPQYRSNKKAIQALDWKNTADKPKLKTLYRERDKLLKGGGFTEYGFKSDIKNFYKHFAENIGSSVAVHGIAPQVWAAFERVLFKKEGKKVHFKKTGDIRSLRGYSVTGKSGGVEIIFRGSYIEWKGLNLPLKLSPDNAYETEMLSYRVKYVRILRKPGKTRDRWYAQLSLEGKPAIKRNPASGNPVHPVGQGAVGLDIGPQTLAYAAEKEANLVELADRVQNIEREKHLLQRKMDRSRRAANPDNYAENGTIRRGVKLTHNKSKRYLRLQRELCYLQHCQAETRKR

SEQ ID NO: 2177 - protein, 511 aa, Unknown
  Description of Unknown: uncultivated organism sequence
  Category: MG81 effectors
  Description: MG81-456 effector
MAKCSTDTCCLTLPLRLEKWQEDRLAKRFEIARQIYNTMVRAELKKLRAMEQSEPYKANQEKIQALDRKTQTDKQALKALYKERDKLLRDGGFSEYGFKSDIKNYYKHFNNNIGSSVAVHGIAPQVWAAFEKMLFKKEGKKVHFKKKGDIHSLRGYSATGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2178 - protein, 519 aa, Unknown
  Description of Unknown: uncultivated organism sequence
  Category: MG81 effectors
  Description: MG81-457 effector
MPTKQKEGGNRCVLTLPLLTEPWQEHIIEKRFKIIEHLKNQLISIELRKLKNLQRTKAYKNLIKQIESVPKSERTALYKERNKMLEGKGFSRNVFQDDLGVMQNQFAEHINVQISHRAAWDVWSSFEKFLFGSGQMIHYQKRGTLKSIASKSPKNGMHYFPESNTFKWSGGRQKKIGQKGEQKKVSIKPISLCLRVSPLKTDYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMLYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2179 - protein, 511 aa, Unknown
  Description of Unknown: uncultivated organism sequence
  Category: MG81 effectors
  Description: MG81-458 effector
MAQRHSTPTCCLTLPLQLEKWQEDRLIKRFEIAGKIYNALLNAELKKLHRLEQLPEYKEIQSQLKAYYQNNLPKTAAFKELNNRRSKLLSEHGFSEYAFKGDMKKFYKHFSSNIGSSVATHCIASQVWSAFEKRLFGGGKFVHFKKSGDIRSLKGFSSSRKSGGVEIMFRGDHIEWKGLLLRLKLDPDNQYESEMLSRRIKYVRIIRKPGKAKWRWYAQLSVEGLPAIKRNDETGEPVHPIGRGAVGIDIGPQTIAYVSQTEVALKELADRVQNIEHEKRLIQRKLDRSRRATNPANYADNGTIKRGVKLTRNKSKRYLKLQMELSFLQHKQAEIRKQQHINLANHLLSLGDCFYVEDMAWSSLARKAKETAVSEKTGKYKRKKRFGKSIANKAPASLISILDQKCTSLGLLGVIKVPTSVRASQYNHITKSYEKKTLSQRWNIMPDGRRIQRDIYSAFLLQHVTPQRDGFSDEALQQDYENFVSLHDSVIQQLRLMPKTIASMGIRRTYS

SEQ ID NO: 2180 - protein, 1358 aa, Unknown
  Description of Unknown: uncultivated organism sequence
  Category: MG81 effectors
  Description: MG81-459 effector
MKISKIKNSRPGISVAENKNEESLSRQSLLYYAPVKDGKIRLESKDLEQHVTECNEKAQKLYNVITPEINFYRDENRQKMVENLARNFNAVINNALRSIRNPKEKKEQRVEKEVAFILNLSKKSIKMKKDVFVKSTDLIVKFPENNKYNKKNDKGTGSKEAYIQKMISDLVLRKLKNTLRKEVKLENGYRMQMTEIIISLMSAICLYGNAESFDPAILKAFFEKVDSDYTKYKYVEQIVKSIESQSAKLKVVEKDGRHLLISANADHRKKKYVFEFMRMYAAADEKEKRELTEHIQDLIGLYLCGKAGYENAENRFSDMTESHNCICGKIEEILNELEKPENLSQKKKENLKNTTVKVMALKYRAAVNYLADEVGKTVLGEIREKKVRSCADLYWIEYIDSTVEKLLLKSRNKDGYRYEIGFLSKHIWKEWTQYISGKYIEMGKGVYHFAIPDLSGNLEGEPISICEVKPEYRNGVSGFDYERIRAEESLEREMEKYVLFAVNNFARAVTPEEEREKSGHEDVLLMKTLSEIEESQTKEERQKKHDNNVKNAITLYADADRRILQFFGGQSRFREKEDSLINLYSGEDLYKEIRKELYAIRNITFHYTTKADKDQTQKHDLAEYLFEEEFSDITELFREKYYANNVWKYYDVEVINTIMENIYCGRKYRAAQVPAFKNIISRPELPQVMNGFVKGNSLRRLMNCPDRDVINKYWSALFFVLKELYYYDFLQEQKKPEDNVKERFFRAIEKLSGQENDDKKQKAWESFGNRIDQIGRDRSFGAICQGLMIEYMLQNSDISMVQTETDNGKANNKKQIYKHYRTLLYNCIREAFIEYLREKWEGLRTPVLTVKEWSKEEFCRADGLKHLSLFDHLKKTFNDAESGSSWYMAAHFINQKYLNHLLGSIRNYLQFTEDIEDRAISLGDCVDNKREEKNLRYRNTLEILEFVAQFCERTTNVMEDYFESNQEYAEYLSGFVDYNTTKKETDIEKALYSFCKQKFKVDGKEYMAGIYYDGENLIPNRNIIRANMYGNTSCLKPCMDRITLKEIRTMYADQNKLDLVLKEGVCHTEEEQKAYREYQNEKNRIELFDVCTYTQILNDMQARLIGWSYMRERDLMYYQLGYYYTKLFWTDSISEEDARRRLVGNLVNVEDGAILYQILAFNSYNLPIIANKNNTVTLLKDEGSIGGKAITAFFKNYENAEMIYEEALDLFENMDEHAAIINTRNYIEHFKYFIKSDRSMMDLYSEIYDRFFRHDHNRKKNVPDSLKNVLADNFMIVDIDMELGSKKVGEKKKGFREHKAARIEFTDSGIRSTDMTYTIKPDIKDNKKDKKVLVPARSEVFLKQFRKILEYRIQDKIQ

SEQ ID NO: 2181 - protein, 511 aa, Unknown
  Description of Unknown: uncultivated organism sequence
  Category: MG81 effectors
  Description: MG81-460 effector
MGKSSTDTCCLTLPLKLEKWQEDRLAKRFEIARQIYNTMVRAELKKLDRVKQLPEYRKNQKEIQALDWKNSADKQRLKELYGNQRKILQKQGFTEYSFKADSKDYYKHFIENIGSSVATHGIAPQVWNAFDKMLFQKDGKVVHFKRYGDVHSLKGGSVAHKSGGAEIMFRKTYIEWKGLKLPLKLSPNNAYEAEMLSYRVKYVRILRTRGKTKDRWYAQLSLEGKPAVKYDSNTGKPVHPVGRGAVGLDIGPQTLAYAAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEKTGRIKRKKRFGKSVANKAPASLIGILKLKCISLGLTGVVEVPMLLKASQYNHQSKGYAPKSLSQRWNDMPDGNRIQRDLYSAFLLQHYNSQLENFNQETLERDYPQFVRLHNQTIQRLSALPKTPSSMGIRRSVS

SEQ ID NO: 2182 - protein, 512 aa, Unknown
  Description of Unknown: uncultivated organism sequence
  Category: MG81 effectors
  Description: MG81-461 effector
MGKSSTDTCCLSLPLKLEKWQEDRLAKRFEIARQIYNTLVHAELKRLSQVKRSQQYREIENKIRALDRNDQEDKKELSLLHKLRDDLLRKSGVNDYGFKADIKYFYKHFGENIGANVAVHGIAPQVWSAFDSVLFKKRGKKVHYKKPGDICSLRGYSVTGKSGGSEIMFRGTYIEWKGLKMPLKLSPDNIYESEMLDHRVKYVRIVRKPGKRKDRWYAQLSLECKPVIKCDPVSGEMRHPVGKGPVGLDIGPQTLAYCALSEAGLVELADQVQDIEREKQRLQRRLDRSRRAANPNNYAADGTIKRGVKLTHNKSKRYCILQRELRYLQQQQAETRKRQHTELANYLLSLGDRFYVEDMNWSSLARRAKKTEISEKTGRYKRKKRFGKSIANKAPGSLIDILKQKCESLGIPGVEKLPTSLLKASQYNHQTGEYTPKPRSQRWNDMPDGERIQRDLYSAFLLQHYDPVSKGYDQAALQRDYPQFLQHHHHSIQRLTAKPKTPSSMGIHQRLR

SEQ ID NO: 2183 - protein, 353 aa, Unknown
  Description of Unknown: uncultivated organism sequence
  Category: MG81 effectors
  Description: MG81-462 effector
MSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADQVQCIEQEKSRLQRKMDRSRRASNPDNYAQDGTIKRGVKLTYNKSRRYCKLQKELAYMLYRQAETRKRQHRELINRLLTMGDCFYIEDMHWNSLAHRAKKTEISEKTGRYKRKKRFGKSIANKAPAMLVDMLEQKCKSLELDVVMVNTSLKASQYNHQTGKYEKKTLSQRWNYMPDGEQIQRDLYSAFLLQHVVPEKNAFDNEALCRDYPKFVQYHHEVIERLRSLPKTISSMGIRQSVS

SEQ ID NO: 2184 - protein, 529 aa, Unknown
  Description of Unknown: uncultivated organism sequence
  Category: MG81 effectors
  Description: MG81-463 effector
MAKNNNNNNNDTDTCVLTLPLRVEKWQEDCLLKRFEAARRIYNSLLNFELKKLRQLERTVEYRQIQSVISSAYRSNTKDSPECKDAFKRREKLISANGLAEYGFKSDVKFFYKHFDGLIGSNVAVHCIAVQLWAAFNKYLSGSGKEIHFKRLGEISSLKGYSVKGKSGGREIIFRGQYIEWTRKKKKLLLPLKIDPDNEYEREMLSRRVKYVRIIKKPGKNRLRWYAQLTLEGKPALKYSAETGKPIHSVGKGNVGIDIGPQTIAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWSGLAHRAKETSISEKTGRYKRKKRFGKSLANKAPAMFISILKRKCKTLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2185 - protein, 525 aa, Unknown
  Description of Unknown: uncultivated organism sequence
  Category: MG81 effectors
  Description: MG81-464 effector
MANNNNNTDTCVLTLPLRVEKWQEDCLLKRFEAARRIYNSLLNFELKKLRQLERTVEYRQIQSVISSAYRSNTKDSPECKAALKRREKLIDANDLTEYGFKSDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKNLSERWNYMPISDGSDSSKTKRIQRDLYSAFLLQHTIPQSCSFDKEALRIDYPNFVTMHDAEIHRLESLPKTITSMGVRRSHS

SEQ ID NO: 2186 - protein, 534 aa, Unknown
  Description of Unknown: uncultivated organism sequence
  Category: MG81 effectors
  Description: MG81-465 effector
MGWKSKGRGGKRVKKSSTDTCCLTLPLKLEKWQSDRLEKRFEIGRQIYNTVVRAELKKLHQVERTPQYREIEQKLKEAKQEEAKELWKKRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSSNNDYETEMLSKRVKYVRILRKEGKTKPHWYAQLVLEGKPAIKRDPASGAPKHPVGHGVVGIDIGTRTLAYSADSKVDLIELADRVQNIELEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQEAFGNELYRVFDREALQRDYPKFVEYHRETIQRLSALPKTIPSMGIRRIIS

SEQ ID NO: 2187 - protein, 512 aa, Unknown
  Description of Unknown: uncultivated organism sequence
  Category: MG81 effectors
  Description: MG81-466 effector
MKKCTTDTCCLTLPLKLEKWQEDRLAKRFEIARQIYNTLVRAEFKKLNELERTPEYKKILEQIHSLDWKDSGNRQRLNDLYRERNQILENAKFTEYGFKSDMKFYYKHFSDNIGSCVAVHGIAPQVWAAFEKYLFKPEGKKVHFKRFGDVHSLRGYSKAGESGGAEITFCGTHIRWKNLELPIKLSPDNAYETEMLSRRVKYVRILRKPGKSKDRWYVQLSLEGKPAIKYDRNAGEIKHPVAHGAVGLDIGPQTLAYSAETTADLVELADQVQNIEQEKRRLQRKMDRSRRSTNPGNYNTDGTIRRGVKLTRNKSKAYCKLQRQLAYLQHTQAETRKRQHTELANYLLSLGDCFYVEEMKWSSLAHRAKETAVSEKTGRFKQKKRFGKSIANKAPSTLIGILQQKCESLGLPGIIYVPLSAKASQYNHLTGEYTPKPLSQRWNTMPDAQRVQRDLYSAFLLQHFDSQAGTYNLQSLQRDYPQFLQYHDQSIRRLSEMPKTLSSMGIRKSIRA

SEQ ID NO: 2188 - protein, 538 aa, Unknown
  Description of Unknown: uncultivated organism sequence
  Category: MG81 effectors
  Description: MG81-467 effector
MDNEEKEKDGATCCLTLPLKLEKWQSDHLEKRFEIARQLYNTLVHAELKKKCQVVRMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2189 - protein, 505 aa, Unknown
  Description of Unknown: uncultivated organism sequence
  Category: MG81 effectors
  Description: MG81-468 effector
MAKATTETCCLTLPLKLEKWQADRLDKRLEIARQIYNTLLRFELKKLRILINSEEYKDIENKRSETTDTNEKKKLNKKLDDLRKKAGFTEYSFKTDIKDFYKHFKDNIGSSVAVHGIAPQVWQAFDRLLYGNGREVHFKKRGSINSLRGYSVAGKSGGVEIMFRGDHIEWKGLHLPIKLDPNNVYECEMLQKRIKYCRIVKKQGRSKDHWYVQLMLEGKPAVKCDRHTGELLHPIGSGAVGIDIGPQTIAYVADKEVALKELADKVNNIEHKKQILQRKLDRSRRAANPDNYAPDGTIKRGVKLTHNKSKRYISTQRELADLMRKQAETRKRQHNELANHLLSLGDRFYVEDMQWPSLTHRAKKTEISEKTGRYKRKKRFGKSVGNKAPAMLISILDQKLRSRGKPGVTKVPTSVRASQYNHISDDYHKKELGERWNDMQDGRRIQRDLYSAFLLQHIDTDNNNFDKPTLFRDYENFVLLHDQYIEELKKLPKTLASMGIVRKAS

SEQ ID NO: 2190 - protein, 540 aa, Unknown
  Description of Unknown: uncultivated organism sequence
  Category: MG81 effectors
  Description: MG81-469 effector
MATTDKKDEENLRAYKFRLDPNQAQTTALYQAVGAARYTYNMLTAYNLEVNRLRDDYWKRRHDEGISDADIKKELNALAKEDKRYKQLNYGAFGTQYLTPEKKRHEQAEHRIENGEDPSVVWNQETERSANPWLHTANQRVLVSGLQNASDAWDNFWASRTGKRAGRLVGTPRFKKKGVSRDSFTVPAPEKMGAYGTAYLRGEPAYKQGRRKITDYRHVRLSYLGTIRTFNSTKPLVKAVAAGAKIRRYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATEYTLVGFEDLNVSGMTASAKGTVENPGKNVAQKSGLNRVVLDAAFGVFRNQLEYKAVWYGSAFEKVDRYFASSQTCSECGRKAKTKLTLRDRVFDCAYCGNMMDRDLNAAVNICREAQRLFDEKLASEDRESLNGRGSRGALRGAETVEASRPPASHRRGSP

SEQ ID NO: 2191 - protein, 529 aa, Unknown
  Description of Unknown: uncultivated organism sequence
  Category: MG81 effectors
  Description: MG81-470 effector
MILLAKKNNNDTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFDKYLRGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2192 - protein, 522 aa, Unknown
  Description of Unknown: uncultivated organism sequence
  Category: MG81 effectors
  Description: MG81-471 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQAGKSGGIEIIFRGSYVEWKGLKLPLKLSPDNDYETEMLSKRVKYVRILRKDGKTKTHWYAQLALEGKPAVKRDSISGAPKHPVGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2193 - protein, 473 aa, Unknown
  Description of Unknown: uncultivated organism sequence
  Category: MG81 effectors
  Description: MG81-472 effector
MVHAELKKLRNIENSQPYRQIQKQIEALDWKNQTDKARLKSLYNERNQLLKASGFTEYGFKADIKYYYKHFNDNIGSSVAVHGIAPQVWAAFEKMLFHKEGKKVHYKKKDDIHSLRGYSVTGKSGGVEIIFRETYIEWKGLKLPLKRSPDNAYETEMLSRRVKYVRLLRKPGKRKNRWYVQLSLEGKPAIKRDPESGELRHAIGRGAVGLDIGPQTLAYSACGAVDLVELADQVQNIEQMKRRLQRKLDRSRRATNPNNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNDIPDGERIQRDLYSAFLLQHYDPQAGNFNSALLQQDYPQFVQYHHRAIQRLSTAPKTLSSMGIQRSLR

SEQ ID NO: 2194 - protein, 511 aa, Unknown
  Description of Unknown: uncultivated organism sequence
  Category: MG81 effectors
  Description: MG81-473 effector
MREDSQNTCCLTLPLKIEKWQADRLIKRFEIARQIYNTLVHAELKKLQKMEASAEYRQIQDRIRELNPSDAGAKKEWKILKDKQEKLWKAWKITEYGFKSDIKAYYKYFNENIGAAGATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSRLPRQPIGKGAVGIDIGPQTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLEQKCKSLELDVVTVNTSLKASQYNHQTGKYEKKTLSQRWNRMPDGEQIQRDLYSAFLLQHVVPEKNAFDNEALCRDYPKFVQYHHEVIERLRSLPKTISSMGIRQSVS

SEQ ID NO: 2195 - protein, 523 aa, Unknown
  Description of Unknown: uncultivated organism sequence
  Category: MG81 effectors
  Description: MG81-474 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGSGQMIHYQKRGTLKSIASKSPKNGMHYFPESNTFKWSGGRQKKIGQKGEQKKVSIKPISLCLRVSPLKTDYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWIKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2196 - protein, 512 aa, Unknown
  Description of Unknown: uncultivated organism sequence
  Category: MG81 effectors
  Description: MG81-475 effector
MPTKQKEDSNRCVLTLPLLTEPWQEHIIEKRFKIIEHLKYQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKINKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 2197 - protein, 522 aa, Unknown
  Description of Unknown: uncultivated organism sequence
  Category: MG81 effectors
  Description: MG81-476 effector
MKKSSTDTCCLTLPLKLEKWQSDRLEKRFEIGRQIYNTVVRAELKKLHQVERTPQYREIEQKLKEAKQEEAKELWKKRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSSNNDYETEMLSKRVKYVRILRKEGKTKPHWYAQLVLEGKPAIKRDPASGAPKHPVGHGVVGIDIGTRTLAYSADSKVDLIELADRVQNIELEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQEAFGNELYRVFDREALQRDYPKFVEYHRETIQRLSALPKTIPSMGIRRIIS

SEQ ID NO: 2198 - protein, 538 aa, Unknown
  Description of Unknown: uncultivated organism sequence
  Category: MG81 effectors
  Description: MG81-477 effector
MNNEEKEKEGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2199 - protein, 528 aa, Unknown
  Description of Unknown: uncultivated organism sequence
  Category: MG81 effectors
  Description: MG81-478 effector
MAKKNNNNNDTDTCVLTLPLRVEKWQEDCLLKRFEAARRIYNSLLNFELKKLRQLERTVEYRQIQSVISSAYRSNTKDSLECKDAFKHREKLISANGISKNGFKSDVKFFYKHFDGLIGSSVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2200 - protein, 1355 aa, Unknown
  Description of Unknown: uncultivated organism sequence
  Category: MG81 effectors
  Description: MG81-479 effector
MKISKIKNSRPGISVAENKNEEPLSRQSLLYYAPVKDGKIRLESKDLEQHVTECNEKAQKLYNVITPEINFYRDENRQKMVENLAKNFNAVINNALRSIRNPKEKKEQRVEKEVAFILNLSKKSIKMKKDVFVKSTDLIVKFPENNKYNKKNDKGTGSKEADIQRIISDLVLRKLKKTLRKEVKLENGYRMQMTEITISLMSAICLYGNAESFDPAILKAFFEKVDSDYTKYKYVEQIVKSIESQSAKLKVIEKDGRHLLISANADHRKKKYVFEFMRMYAAADEKEKRELTEHIQDLIGLYLCGKAGYENAENRFSDMIESHNCICGKIEEILNELEKPENLSQQKKENLKNTTVKVMALKYRAAVNYLADEVGKTVLGEIREKKVRSCADLYWIEYIDSTVEKLLLKSRNKKRYRYEIGFLSKHIWKEWTQYISGKYIEIGKGVYHFAIPDLSGALEGESVSICEVKPEYRNGVSGFDYERIRAEESLEREMEKYVLFAVNNFARAVTPEEEREKSGHEDVLLMKTLSEIEESQTKEERQKKHDNNVKNAITLYADADRRILQFFGGQSRFREKEDSLINLYSGEDLYKEIRKELYAIRNITFHYTTKAEKDQTQKHDLAEYLFEEEFSDITELFREKYYANNVWKYYDAEVINTIMENIYCGRKYRAAQVPAFKNIISRPELPQVMNGFVKGNSLRRLMNCPDRDVINKYWSALFFVLKELYYYDFLQEQKKPEDNVKERFFRAIKKLSGQEKDDEKQKAWESFGNRIDQIGRDRSFGAICQGLMIEYMLQNSDISMVQTETDNGKANNKKQIYKHYRTLLYNCISEAFIEYLREKWKELRTPVLTAKEWSKEEFCRVDGLKHLSLFDHLKETFNDAESGSSWYMAAHFINQKYLNHLLGSIRNYLQFTEDIEDRAISLGDCVDNKREEKNLRYRNTLEILEFVAQFCERTTNVMEDYFESNQEYAEYLSDFVDYNTTKKETDIEKALYSFCKQKFKVDGKEYMAGIYYDGENLIPNRNIIRANMYGNTSCLKPCMDRITLKEIRTMYADQNKLDLVLKEGVCHTEEEQKAYREYQNEKNRIELFDVCTYTQILNDMQARLIGWSYMRERDLMYYQLGYYYTKLFWTDSISEEDARRRLVGNLVNVEDGAILYQILAFNSYNLPIIANKNNTVTLLKDEGSIGGKAITAFLKNYENAEMIYKEALDLFENMDEHAAIINTRNYIEHFKYFIKSDRSMMDLYSEIYDRFFRHDHNRKKNVPDSLKNVLADNFMIVDIDMELGSKKVGEKKKGFREHKAARIEFTDSGIRSTDMTYTIKPDIKDNKKVLVPARSEVFLKQFRKILEYRIQDKTQ

SEQ ID NO: 2201 - protein, 528 aa, Unknown
  Description of Unknown: uncultivated organism sequence
  Category: MG81 effectors
  Description: MG81-480 effector
MILLAKNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2202 - protein, 529 aa, Unknown
  Description of Unknown: uncultivated organism sequence
  Category: MG81 effectors
  Description: MG81-481 effector
MILLANNNNNNTDTCVLTLPLRVEKWQEDCLLKRFEAARRIYNSLLNFELKKLRQLERTVEYRQIQSVISNAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2203 - protein, 318 aa, Unknown
  Description of Unknown: uncultivated organism sequence
  Category: MG81 effectors
  Description: MG81-482 effector
MLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILGSKLNQYGGQLNKINTYEFKASQYDHTDDTFTKHNRSERWHILSNGDKNQRDLYSAFLIMNSDISLKHCNRKKCNETYSNFKVLQDKEIERLYSDIRKGNCKNISSFGFQRNAKAM

SEQ ID NO: 2204 - protein, 535 aa, Unknown
  Description of Unknown: uncultivated organism sequence
  Category: MG81 effectors
  Description: MG81-483 effector
MILLANNNNNNNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2205 - protein, 508 aa, Unknown
  Description of Unknown: uncultivated organism sequence
  Category: MG81 effectors
  Description: MG81-484 effector
MADKECCVLTLPLQTEIWQEHIIEKRFAIMEHLKNQLIAKELRRLKNLERTKEYRNLIDEINNTPKEKRKALFSKRRKLLKDSGFSEYDFKDDIAGKNSLMQKHFIEHIATQIAHKLASDVWRSFDKFLFGNGRFIHFSKRGSLRSVASQKNGNGMTYKNGYFIWNGGQSKNKIILKIKVTPPKNEYEKEMLSKKIKYLRIVKKWVKTRYKYYLQFALEGKPVKKDRIVNKGNVGIDIGTQTVAISSANSVKILELADKIDKNHTKKKILQRKMDRSRRYTNPQNYNEDGTIKKPPKGQRFSWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2206 - protein, 496 aa, Unknown
  Description of Unknown: uncultivated organism sequence
  Category: MG81 effectors
  Description: MG81-485 effector
MAKNEQNCCVLTLPLLTEPWQEHIIETRFRIMEQLKNALIAKELGKLNNLKRTREWKRLMKSIQDAKDEKEKKQLFKKRTELLRNVGFSDFSFSNDVTNLKIHKHFAEHINSGIAQRAGKDVWRAFEKYLFSNGKTVHFHRRGTLDSVANRYAREGMMIDGDILTWKGGQSDHQIVLKIRIRRLKNAYEREMLQKTVRNLRIVRKWMKTRYKYYLQITLQGDPASKYRSVGKGRIGIDIGTQTIAWSSPTEVRLAELAAGIKRNHAEKTALQRKMDRSRRTANPQNYNPDGTIRRGVKLRWVKTKHYLRMEGRVRELERKNADIRQYEHICMANHILSLGNEVYIEDMSFKGLQGRAKETKLDKNGRFARKKRFGKSLANRAPSMFVTILENKLKASGGSLHKVNTRTFRASQYDHTADEFKKKTLGQRWNHLKNGDKIQRDLYSAFLLMNAAPSLEEPDKKLCGKTYPQFNRLHDAEMERLRAEEKPHLSSMGIH

SEQ ID NO: 2207 - protein, 527 aa, Unknown
  Description of Unknown: uncultivated organism sequence
  Category: MG81 effectors
  Description: MG81-486 effector
MAKNNNNNDTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSSVAVHCIAVQLWAAFDKYLSGSGKEIHFKRLGDISSLKGYSVKGKSGGGEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDCFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 2208 - protein, 511 aa, Unknown
  Description of Unknown: uncultivated organism sequence
  Category: MG81 effectors
  Description: MG81-487 effector
MAARSKTDTCCLTLPLRLEKWQADRLAKRFHIAEQIYNAMLLSWIKKLRVVEQMPEYRAIQSQLQKLYEEDKQKTDAAKELFSRRKEILKKNGFPEYSFKTGIRKYYAHFKENIASNVATHCIASQVWDAFSKKLFGNGGRLHFKRAGDIHSLRGYSKSGESGGVEIIFRGTYIEWNGLRLPLKLDPQNPYEAEMLAKRVKYVRILRTPGKSIDHWYAQLALEGKPTVKRNAATGEPVHPSGRGAVGIDIGPRTIAYVSENEVGLRELADQVENIERDKRRLQRKLDRSRRATNPDNYAPDGTIKRGIKHTHNKSSRYRRMQKELSLLQHRQALIRKRQHTELANHLLSLGDCFYVEDMPWKGLARRTKETTVSPTTGRYRRKKRFGKSISNKAPGTLILILEQKCKSRGVSGVIRVPTNIKASQYNHMTDTYKPKPLSQRWNDMPDGKRIQRDLYSAFLLQHVTPELDGFERTKLIEDYDGFIHLHDKEIHELTLAPKTIASMGISRTRS

SEQ ID NO: 2209 - protein, 511 aa, Unknown
  Description of Unknown: uncultivated organism sequence
  Category: MG81 effectors
  Description: MG81-488 effector
MAKCSTDTCCLTLPLRLEKWQEDRLAKRFEIARQIYNTMVRAELKKLRAIEQSEPYKANQEKIQALDWKTQTDKQALKALYKERDKLLQDGGFSERGFKSDIKNYYKHFNNNIGSNVAVHGIAPQVWAAFEKMLFKKEGKKVHFKKKGDIRSLRGYSITRKSGGVEIIFRETYIEWKGLKLPLKLSPDNSYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2210 - protein, 511 aa, Unknown
  Description of Unknown: uncultivated organism sequence
  Category: MG81 effectors
  Description: MG81-489 effector
MARCTTPTCVLTLPSHLEKWQEDRLAKRFEIAQKIYNALLGAELKKLRRLEQTPKYRAIKKDLAALYGDKEKNADRIRALYKKRNKLLKDNSFTEYGFTVDAKLYYKPFRTNIGSCVAVHCIAPQVWSAFEKYLFGNGKRIHFKRPGEIYSLRGYSSKTSSGVEIIYRGDHIEWNKLRLPLKLDLGNQYEEEMLTNRVKYVRILRRPGKNRDHWYAQLTLEGLPAIKRDDETGDPVHSIGNGPVGIDIGPQTIAYSSSKEAGLLELADRVQNIENKKCRIQRKMDRSRRAANPGNYNPDGTIKRGVPLTRNKSKRYLRLQNELAWIQHQQAAIRKEQHVALANYLLTLGDCFYIEDMNWQGLARRAKETAIPEPEKERKCRRKKRFGKSIANKAPATLVTILKNKCTSLGLPGVIPISTKVRASQYNHLTDSYQKKELSQRWNEMPDGRKIQRDLYSAFLLQHMNSQLDGFDRASLLRDYESFVSLHDQAILRAAAVPKLISSMGIKRTAN

SEQ ID NO: 2211 - protein, 426 aa, Unknown
  Description of Unknown: uncultivated organism sequence
  Category: MG81 effectors
  Description: MG81-490 effector
MIHISAKYGVDSIFALSKAEDIWRAVEQCLYGDGRTLHFTKYGKLPGIRAKQINRGIRFTVKDNHLCFKLRKIAFGIKINDRFQHDEITAVLSYLNDPEAADRRAVDVFINDGSCIDTYRPCYATLVPKMIRGKYRVYLYLTIEGKAKLKYDRFGNHRHQYGTGMIGADIGIQTVAYTSDTEVGLKNLSERGNSIQHSERKERLLNRAMFRSRQATNPQNFNCNGSVKKGAKNWKYSKHYKKLKYKYSELCRINAINRRLAINEDANHLRSLGDIFVTEPQNVRKLMRRAKKTTRDKNGRFNKKKRFGKSIRCRCPAGFQRTVAKKFVNTGGTYIEVPYNYRASQYDHTADDYIKKKLSARMYKLQDGTKVQRDWYSSFLLYCYNPHTNAIDKTKCAAAFTTQYHKEKTLIEQIKKRKIKVLNSGI

SEQ ID NO: 2212 - protein, 540 aa, Unknown
  Description of Unknown: uncultivated organism sequence
  Category: MG81 effectors
  Description: MG81-491 effector
MATTDKKDEENLRAYKFRLDPNQAQTTALYQAVGAARYTYNMLTAYNLEVNRLRDDYWKRRHDEGISDADIKKELNALAKEDKRYKQLNYGAFGTQYLTPEKKRHEQAEHRIENGEDPSVVWNQETERSANPWLHTANQRVLVSGLQNASDAWDNFWASRTGKRAGRLVGTPRFKKKGISRDSFTVPAPEKMGAYGTAYLRGEPAYKQGRRKITDYRHVRLSYLGTIRTFNSTKPLVKAVAAGAKIRRYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATEYTLVGFEDLNVSGMTASAKGTVENPGKNVAQKSGLNRVVLDAAFGVFRNQLEYKAVWYGSAFEKVDRYFASSQTCSECGRKAKTKLTLRDRVFDCAYCGNMMDRDLNAAVNICREAQRLFDEKLASEDRESLNGRGSRGALRGAETVEASRPPASHRRGSP

SEQ ID NO: 2213 - protein, 511 aa, Unknown
  Description of Unknown: uncultivated organism sequence
  Category: MG81 effectors
  Description: MG81-492 effector
MAKCSTDTCCLTLPLRLEKWQEDRLAKRFEIARQIYNTMVRAELKKLRAMEQSKPYKANQEKIQALDWKTQADKQALKALYKERDKLLRDGGFSEYGFKSDIKNYYKHFNNNIGSSVAVHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2214 - protein, 511 aa, Unknown
  Description of Unknown: uncultivated organism sequence
  Category: MG81 effectors
  Description: MG81-493 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGQKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDHPQFVQYHHDAVLRLYAMPKTPSSMGIKRSLR

SEQ ID NO: 2215 - protein, 511 aa, Unknown
  Description of Unknown: uncultivated organism sequence
  Category: MG81 effectors
  Description: MG81-494 effector
MREDSQNTCCLTLPLKIEKWQADRLIKRFEIARQIYNTLVHAELKKLQKMEASAEYRKIQDRIRELNPSDVRAKKEWKILKDKQEKLWKAWKITEYGFKSDIKAYYKYFNENIGSAVATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLKQKCKSLELDVVMVNTSLKASQYNHQTGKYEKKTLSQRWNRMPDGEQIQRDLYSAFLLQHVVPEKNAFDNEALCRDYPKFVQYHHEVIERLRSLPKTISSMGIRRSVS

SEQ ID NO: 2216 - protein, 511 aa, Unknown
  Description of Unknown: uncultivated organism sequence
  Category: MG81 effectors
  Description: MG81-495 effector
MAKCSTDTCCLTLPLRLEKWQEDRLAKRFEIARQIYNTMVRAELKKLRAMEQSEPYKANQEKIQALDWKTQADKQTLKALYKERDKLLQDGGFSERGFKSDIKNYYKHFNNNIGSNVAVHGIAPQVWAAFEKMLFKKEGKKVHFKKKGDIRSLRGYSVTGRSGGVEIIFRETYIEWKGLKLPLKLSPDNIYETQMLSYRVKYVRLLRKPGKRKDRWHAQLSLEGKPVIKYNPKTGEVRHPIGKGAVGLDIGPQTLAYSAATGADLVELANQVQNVEQEKRRLQRKLDRSRRATNPGNYADDGTIRRGIALTHNQSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKKSLR

SEQ ID NO: 2217 - protein, 540 aa, Unknown
  Description of Unknown: uncultivated organism sequence
  Category: MG81 effectors
  Description: MG81-496 effector
MMYNTKYQAKRGDPVGEKNSNDTDTCVLTLPLRVEKWQEDCLLKRFEAARRIYNSLLNFELKKLRQLERTVEYRQIQSVISSAYLSNTKDSLECKNAFKRREKLISANGISENGFKSDVKFFYKHFDGLIGSSVAVHCIAVQLWAAFDKYLSGSGKEIHFKRLGDISSLKGYSVKGKSGGLEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTITSMGVRRSHS

SEQ ID NO: 2218 - protein, 529 aa, Unknown
  Description of Unknown: uncultivated organism sequence
  Category: MG81 effectors
  Description: MG81-497 effector
MILLAKKNNNDTDTCVLTLPLRVEKWQEDCLLKRFEAARRIYNSLLNFELKKLRQLERTVEYRQIQSVISSAYRSNTKDSPECKDAFKRRKKLTDENGISEYGFKSDVKFFYKHFDGLIGSSVAVHCIAVQLWAAFDKYLRGNGKEIHFKRLGDISSLKGYSVRGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2219 - protein, 528 aa, Unknown
  Description of Unknown: uncultivated organism sequence
  Category: MG81 effectors
  Description: MG81-498 effector
MAKNNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGGEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKCGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 2220 - protein, 511 aa, Unknown
  Description of Unknown: uncultivated organism sequence
  Category: MG81 effectors
  Description: MG81-499 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSSGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2221 - protein, 525 aa, Unknown
  Description of Unknown: uncultivated organism sequence
  Category: MG81 effectors
  Description: MG81-500 effector
MANNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTVTSMGVRRSHS

SEQ ID NO: 2222 - protein, 511 aa, Unknown
  Description of Unknown: uncultivated organism sequence
  Category: MG81 effectors
  Description: MG81-501 effector
MREDSQNTCCLTLPLKIEKWQADRLIKRFEIARQIYNTLVHAELKKLQKMEASAEYRQIQDRIRELNPSDVRAKKEWKILKDKQEKLWKAWKITEYGFKSDIKAYYKYFNENIGSAVATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPRTLAYSAEGGADLVELADQVQCIEQEKSRLQRKMDRSRRASNPDNYAQDGTIKRGVKLTHNKSRRYCKLQKELAYMLYRQAETRKRQHRELINRFLTMGDCFYIEDMHWNSLAHRAKKTEISEKTGRYKRKKRFGKSIANKAPAMLVDMLKQKCKSLELDVVMVNTSLKASQYNHQTGKYEKKTLSQRWNHMPDGEQIQRDLYSAFLLQHVVPEKNAFDNEALCRDYPKFVQYHHEVIERLRPLPKTISSMGIRRSVS

SEQ ID NO: 2223 - protein, 543 aa, Unknown
  Description of Unknown: uncultivated organism sequence
  Category: MG81 effectors
  Description: MG81-502 effector
MATTDKKDEENLRAYKFRLDPNQAQTTALYQAVGAARYTYNMLTAYNSEVNRLRDDYWKKRHDEGISDADIKKELKALAKEDKRYKQLKYGAFSTQYLTPERDRHKDAALRIKNGEDPSVVWNQETERSANPWLHTVNRRVLVSGLQNASDAWDNFWDSRMGKRAGRLVGTPRFKKKGVSRDSFTVPAAEKAEKMGAYGTAYLRGEPAYKQGRRKITDYRHVRLSYLGTIRTFNSTKPLVKAVAAGAEIRSYTVSRNADRWYVSFLVKFSEPIRRSVTKRARAAGAVGVDLGVKYLASLSDSEAPQRFPNLKFAEGLPSLENPRWSEASSRRLHKLQRALVRSQKGSNRRSRLVKQIARLHHMTALRRESNLHQLTKKLATGYTLVGFEDLNVSGMTASAKGTVENPGKNVAQKSGLNRVVLDAAFGVFRNQLEYKAVWYGSAFEKVNRYFASSQMCSECGRKVKTKLTLRDRVFDCVYCGNMMDRDFNAAVNICREAQRLFDEKLASEDGESLNGRGSRGALRGAKTVEASRPPASHRRGSP

SEQ ID NO: 2224 - protein, 511 aa, Unknown
  Description of Unknown: uncultivated organism sequence
  Category: MG81 effectors
  Description: MG81-503 effector
MAKCSTDTCCLKLPLRLEKWQEDRLAKRFEIARQIYNTMVRAELKKLRAMEQSEPYKANQEKIQALDWKTQADKQALKALYKERDKLLRDGGFSEYGFKSDIKNYYKHFNNNIGSSVAVHGIAPQVWAAFEKMLFKKEGKKVHFKKKGDIRSLRGYSATGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERVQRDLYSAFLLQHYDPQTNTFDANSLHQDYPQFVQYHHDAVLRLYAMPKTPSSMGIKKSLR

SEQ ID NO: 2225 - protein, 511 aa, Unknown
  Description of Unknown: uncultivated organism sequence
  Category: MG81 effectors
  Description: MG81-504 effector
MREDSQNTCCLTLPLKIEKWQADRLIKRFEIARQIYNTLVHAELKKLQKMEASAEYRKIQDRIRELNPSDVRAKKEWKILKDKQEKLWKAWKITEYGFKSDIKAYYKYFNENIGSAVATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLKQKCKSLELDVVMVNTSLKASQYNHQTGKYEKKTLSQRWNHMPDGEQIQRDLYSAFLLQHVVPEKNAFDNEALCREYPKFVQYHHEVIERLRSLPKTISSMGIRRSVS

SEQ ID NO: 2226 - protein, 530 aa, Unknown
  Description of Unknown: uncultivated organism sequence
  Category: MG81 effectors
  Description: MG81-505 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKCGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 2227 - protein, 498 aa, Unknown
  Description of Unknown: uncultivated organism sequence
  Category: MG81 effectors
  Description: MG81-506 effector
MKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2228 - protein, 511 aa, Unknown
  Description of Unknown: uncultivated organism sequence
  Category: MG81 effectors
  Description: MG81-507 effector
MAKCSTDTCCLTLPLRLEKWQEDRLAKRFEIARQIYNTMVRAELKKLRAMEQSEPYKANQEKIQALDRKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKAPSSMGIKRSLR

SEQ ID NO: 2229 - protein, 550 aa, Unknown
  Description of Unknown: uncultivated organism sequence
  Category: MG81 effectors
  Description: MG81-508 effector
MGWKSKGRGGTLVDNEEKKEDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2230 - protein, 526 aa, Unknown
  Description of Unknown: uncultivated organism sequence
  Category: MG81 effectors
  Description: MG81-509 effector
MAKNNNNDTDTCVLALPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWVAFDKYLSGSGKEIHFKRLGDISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2231 - protein, 529 aa, Unknown
  Description of Unknown: uncultivated organism sequence
  Category: MG81 effectors
  Description: MG81-510 effector
MILLAKNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2232 - protein, 512 aa, Unknown
  Description of Unknown: uncultivated organism sequence
  Category: MG81 effectors
  Description: MG81-511 effector
MKKSSTDTCCLTLPLKLEKWQEDRLAKRFEIARQLYNTLVHAELKRLAQVKQTAEYRENERKIRALDWNDPGDQTKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRGRWYAQLVLEAKPAIKADPVTGKAVHPIGSGPVGLDIGPQTLAYSAAGAAGLVELADRVQNIEQEKRCLQRKMDRSRRAANPDNYAEDGTIRRGVKLTHNKSKRYRRSQQELKYLQHRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPASMGIRRSIA

SEQ ID NO: 2233 - protein, 511 aa, Unknown
  Description of Unknown: uncultivated organism sequence
  Category: MG81 effectors
  Description: MG81-512 effector
MREDSQNTCCLTLPLKIEKWQADRLIKRFEIARQIYNTLVHAELKKLQKMEASAEYRQIQDRIRELNPSDAGAKKEWKILKDKQEKLWKAWKITEYGFKSDIKAYYKYFNENIGAAGATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADRVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLEQKCKSLELDVVMVNTSLKASQYNHQTGKYEKKTLSQRWNRMPDGEQIQRDLYSAFLLQHVVPEKNAFDNEALCRDYPKFVQYHHEVIERLRSLPKTISSMGIRRSVS

SEQ ID NO: 2234 - protein, 511 aa, Unknown
  Description of Unknown: uncultivated organism sequence
  Category: MG81 effectors
  Description: MG81-513 effector
MREHSQNTCCLTLPLKIEKWQADRLIKRFEIARQIYNTLVHAELKKLQKMEASAEYRQIQDRIRELNPSDAGAKKEWKILKDKQEKLWKAWKITEYGFKSDIKAYYKYFNENIGAAGATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADRVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLEQKCKSLELDVVMVNTSLKASQYNHQTGKYEKKTLSQRWNRMPDGEQIQRDLYSAFLLQHVVPEKNAFDNEALCRDYPKFVQYHHEVIERLRSLPKTISSMGIRRSVS

SEQ ID NO: 2235 - protein, 536 aa, Unknown
  Description of Unknown: uncultivated organism sequence
  Category: MG81 effectors
  Description: MG81-514 effector
MDNEEKKEDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRNEGKTKPHWYAQLVLEGKPAIKRDPASGAPKHPVGHGAVGIDIGTRTLAYSADSKVDLIELADLVQNIEQEKLLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFWKSIANKAPSMLIALLDQKCKSLNLEGVKKVDTAVKASQYNHQTDECKAKELKERWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2236 - protein, 542 aa, Unknown
  Description of Unknown: uncultivated organism sequence
  Category: MG81 effectors
  Description: MG81-515 effector
MATTDKKDKDKEKLRAYKFRLDPNQAQTIALYQAAGAARYTYNMLTAYNLEVNRLRDDYWKKRHDEGISDADIKKELNALTKEDKRYKQLKYGAFGTQYLTPEKKRHEQAEHRIENGEDPSVVWNQETERSANPWLHTANQRVLVSGLQNASDAWDNFWASRTGKRAGRLVGAPRFKKKGISRDSFTVPAAETMGAYGTAYLRGEAAYQQGKRTITDYRHVRLSYLGVIRTYDSTKPLVKAVAAGAEIRSYTVSRNADRWYVSFLVKFSEPIRRSATKRARAAGAVGVDLGVKYLASLSDSEAPQRFPNLKFAEGLPSLENPRWSEASSRRLHKLQRALARSQKGSNRRSRLVKQIARLHHMTALRRESNLHQLTKKLSTGYTLVGLEDLNVSGMTASAKGTVENPGKNVAQKSGLNRVVLDAAFGVFRYQLEYKTAWYGSTLEKIDRYFASSQTCSECGRKAKTKLTLRDRVFDCAYCGNMMDRDFNAAVNICREAQRLFNKKLASENGESLNGRGSRGALQGAETVEASRPPTSHRRGSP

SEQ ID NO: 2237 - protein, 512 aa, Unknown
  Description of Unknown: uncultivated organism sequence
  Category: MG81 effectors
  Description: MG81-516 effector
MKKCTTDTCCLTLPLKLEKWQEDRLAKRFEIARQIYNTLVRAEFKKLNELERTPEYKKILEQIHSLDWKDSGSRQRLNDLYRERNQILKNAKFTEYGFKSDMKFYYKHFSDNIGSCVAVHGIAPQVWAAFEKYLFKPEGKKVHFKRFGDVHSLRGYSKAGESGGAEITFCGTHIRWKNLELPIKLSPDNAYETEMLSRRVKYVRILRKPGKSKDRWYVQLSLEGKPAIKYDRNAGEIKHPVAHGAVGLDIGPQTLAYSAETTADLVELADQVQNIEQEKRRLQRKMDRSRRSTNPGNYNTDGTIRRGVKLTRNKSKAYCKLQRQLAYLQHTQAETRKRQHTELANYLLSLGDCFYVEEMKWSSLAHRAKETAVSEKTGRFKQKKRFGKSIANKAPSTLIGILQQKCESLGLPGIIYVPLSAKASQYNHLTGEYTPKPLSQRWNTMPDAQRVQRDLYSAFLLQHFDSQAGTYNLQSLQRDYPQFLQYHDQSIRRLSEMPKTLSSMGIRKSIRA

SEQ ID NO: 2238 - protein, 535 aa, Unknown
  Description of Unknown: uncultivated organism sequence
  Category: MG81 effectors
  Description: MG81-517 effector
MILLANNNNNNNNNNNNTDTCVLTLPLRVEKWQEDCLLKRFEAARRIYNSLLNFELKKLRQLERTVEYRQIQSVISSAYRSNTKDSLECKDAFKRREKLISANGISENGFKSDVKFFYKHFDGLIGSNVAVHCIAVQLWAAFDKYLSGSGKEIHFKRLGDISSLKGYYVKGKSGGCEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTITSMGVRRSHS

SEQ ID NO: 2239 - protein, 524 aa, Unknown
  Description of Unknown: uncultivated organism sequence
  Category: MG81 effectors
  Description: MG81-518 effector
MAKNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2240 - protein, 510 aa, Unknown
  Description of Unknown: uncultivated organism sequence
  Category: MG81 effectors
  Description: MG81-519 effector
MAARASTDTCCLTLPLLLEKWQSDRLEKRFEIARQIYNTLLRFELKKLERLKQTEEYQAILEKLQALDDSAQSGAERKTLFRELDAMRKKAGFTEYGFKSDIKDFYKHFNDNIGSNVAVHGIAPQVWQAFDRLFYGNGKKIHFKKRGDIHSLRGYSVAGKSGGVEIIYRGAFVEWKGLKLRIKHDSSNEYETEMLQNRIKYCRIVKREGKNKTRWYVQLMLEGKPAVKRDKQTDAPKHPVGQGSVGIDIGPQTIAYVANHEAALLELADKVQNIEREKRILLRKLDRSRRATNPDNYREDGTICSGKKLVWHKSNRYLRCQKQLSYLMRQQAEIRKAQHNELANHLLSLGDRFFVEDMEWPALTHRSKKTEISEKTGRYKKKKRFGKSVGNKAPALLIELLNQKLHSRGKEGVIKVPTTVRASQYNHITDTYQKKELSQRWNEMPDGKRIQRDLYSAFLLQHMNEAQTGFDRSALQRDYQAFTQLHDQVIDELRQAPKTIASMGVVRTKR

SEQ ID NO: 2241 - protein, 356 aa, Unknown
  Description of Unknown: uncultivated organism sequence
  Category: MG81 effectors
  Description: MG81-520 effector
MEATKTLKLRIKDKHAAVLSLMAREVNQVWNYCNETSSRAIRERREWLSGFDLQKLTAGYSKCEGVRIGSATVQLVCEEYATRRKQFKKARLNWRVSNPKSAKYSLGWVPFKAGGVKYKAGQVSFLGHRFSLWDSYGLSRFDLRAGSFSQDARGRWYLNVCVKVDVPKSAGTGLVGVDLGLKTAATCSDGEELASGLYRKHEGALGIAQRARKKGRVRAIHAKIANTRKDAMHKFSTGLVARNAAIFVGNVSADAMVKTRMAKSTLDAGWSMLKTMLEYKSHQAGIVFEEVNEAYTTQTCSSCGVIPSSSPKGRTGLRMRRWTCCGCGAEHDRDVNAAMNIAARGHARLAGGIPVL

SEQ ID NO: 2242 - protein, 534 aa, Unknown
  Description of Unknown: uncultivated organism sequence
  Category: MG81 effectors
  Description: MG81-521 effector
MGWKSTGRGGTRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSAVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLSEYNRKELKKEFGEELYRVFDREALQRDYPQFVAYHHMTIQRLSELPHTIPSMGIRRIIS

SEQ ID NO: 2243 - protein, 538 aa, Unknown
  Description of Unknown: uncultivated organism sequence
  Category: MG81 effectors
  Description: MG81-522 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREVLQRDYPQFVAYHHMTIQRLSELPHTIASMGIRRSIS

SEQ ID NO: 2244 - protein, 505 aa, Unknown
  Description of Unknown: uncultivated organism sequence
  Category: MG81 effectors
  Description: MG81-523 effector
MAKATTDTCCLTLPLKLEKWQEDRLDKRLEIARKIYNTLVNFELKKLRKLEANSDYIALQEKLKETTNNTERKKLYKEIDKLRKEAGFTEYAFKSDVKAFYKVFNANIGSAVAVHGIAPQVWAAFDRLFYGNGKAVHFKRYGEINSLRGYSVAGKSGGVEIIYHETHIEWKGLKLPIKLDPDNDYEREMLQYRVKYCRIIRKPGRNKNHWYVQLSLEGKPAVKYDRNTGEVRHPVGSGAVGIDIGPQTIAYASDTEVALKELADKVNNIEQKKRVLQRKLDRSRRATNPDNYAPDGTIRRGVKLTRNKSRKYLKCQKELAYIQRQQADIRKRQHNELANHLLILGDRFYVEDMEWPALTHRAKKTEISEKTGKIKRKKRFGKSVGNKAPASLIGLLDLKLKSRGLAGVIRVDTRVRASQYNHLSDDYRKKELRDRWNDMPDGRHIQRDLYSAFLLQHMNEKQDGFDKAALHRDYEQFTERHNQCIEELRTAPKTLASMGIVRRAG

SEQ ID NO: 2245 - protein, 521 aa, Unknown
  Description of Unknown: uncultivated organism sequence
  Category: MG81 effectors
  Description: MG81-524 effector
MLILGRRMYMPAKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVAPVKTNYEKEMVANNETKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2246 - protein, 511 aa, Unknown
  Description of Unknown: uncultivated organism sequence
  Category: MG81 effectors
  Description: MG81-525 effector
MGKSSTDTCCLTLPLKLEKWQEDRLAKRFEIARQIYNTMVRAELKKLERVKQLPEYRKNQKEIQELDWKNSADKPRLKELRANQKRILQKQGFTEYGFKADSKDYYKHFIENIGSSVATHGIAPQVWNAFDKMLFQKDGKVVHFKRHGDVHSLKGGSVTHKSGGAEIMFRKTYIEWKGLKLPLKLSPNNAYEAEMLSYRVKYVRILRTRGKTKDRWYAQLSLEGKPAVKFDSSTGKLVHPVGRGAVGLDIGPQTLAYAAADEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEKTGKIKRKKRFGKSVANKAPASLIGILKLKCISLGLTGVVEVPMLLRASQYNHQSKDYEKKSLSQRWNDMPDGNRIQRDLYSAFLLQHYNSQSESFDQETLERDYPQFVRLHNQTIQRLSALPKTPSSMGIRRSVS

SEQ ID NO: 2247 - protein, 528 aa, Unknown
  Description of Unknown: uncultivated organism sequence
  Category: MG81 effectors
  Description: MG81-526 effector
MILLTKNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVGKMNWPGLAHRAKETSISEKTGRYKRKKRFGKSLANKAPAMFISILKRKCETLGLPGVVEVDTYNLKASQYNHLSDTCEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 2248 - protein, 511 aa, Unknown
  Description of Unknown: uncultivated organism sequence
  Category: MG81 effectors
  Description: MG81-527 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPPSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2249 - protein, 333 aa, Unknown
  Description of Unknown: uncultivated organism sequence
  Category: MG81 effectors
  Description: MG81-528 effector
MAKCSTDTCCLTLPLRLEKWQEDRLAKRFEIARQIYNTMVRAELKKLRAMEQSEPYKANQEKIQALDWKTQADKQALKALYKERDKLLQDGGFSERGFKSDIKNYYKHFNNNIGSNVAFHGIAPQVWAAFEKMLFKKEGKKVHFKKKGDIRSLRGYSATGRSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLKNTAGIKISPASAS

SEQ ID NO: 2250 - protein, 512 aa, Unknown
  Description of Unknown: uncultivated organism sequence
  Category: MG81 effectors
  Description: MG81-529 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDVLAMENQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2251 - protein, 508 aa, Unknown
  Description of Unknown: uncultivated organism sequence
  Category: MG81 effectors
  Description: MG81-530 effector
MADKECCVLTLPLQTEIWQEHIIEKRFAIMEHLKNQLIAKELRRLKNLERTKEYRNLIDEINNTPKEKRKALFSKRRKLLKDSGFSEYDFKDDIAGKNSLMQKHFIEHIATQIAHKLASDVWRSFDKFLFGNGRFIHFSKRGSLRSVASQKNGNGMTYKNGYFIWNGGQSKNKIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKEQRFSWYKSKKYIQLAGKVRELERKNADIRKYQHTCLANWILSLGDTVYVEQMNFSGLQRRAKETKIDKNGKYAKKKRYGKSLANKAPSMFLTILGSKLNQYGGQLNKINTYEFKASQYDHTDDTFTKHNRSERWHILSNGDKNQRDLYSAFLIMNSDISLKHCNREKCNETYSNFKVLQDKEIERLYSDIRKGNCKNISSFGFQRNAKAM

SEQ ID NO: 2252 - protein, 1308 aa, Unknown
  Description of Unknown: uncultivated organism sequence
  Category: MG81 effectors
  Description: MG81-531 effector
MKVSKVNHVRAAVNKKGILYNTPVSEKRNVIEIKGHVREVNEKAQKLYATMGTIDEEIEKVSPKDLNNFKRVFDGYIKECAKTMSRRANKYGFDASKFRNVFEQTTYYSSKKDRTTGEWKNESIASGRFFKWNSDPKTVINQLINTYLRKSLYRTEKAGTKEVYLPDALKKLALAVYDKENFPNGVNALSYEEKTALAQAIYKDYSGEKKIDSIAESIQSQDVKVQSFSKDGKTVLKLSSAEDLNKTNPGKNKGFIFEFLKDFCNADKSGQDELRKHMRKLILLYYCGPEAYRTAEDNGIFADGFGECLPDEAESFCQDAIEEMANLPIAEEKGEKKRVRAAIKKALEEQIAASYRIAVKEPGITESDRFWIDYIEKTAGKIIVDCRMSQWQSRCMKKSLCLMTYQEWETYISSRFIDMGKAAYHFAMPKDLTSLNAASFGTVNALFKDGITSFDYEYIKAEESIEREISGYISSALNTFTASSILPAQREELLAKKDILSLRAEDENLSENMMKNILRFFGGSSVWKEKQEFSKENRVAFFSALQDRLRYVRNSSFHYASGEDTSRVKENPAVLALISGETERVGSIFAKKYYSNNVPMFYTEKDIEKMMENLYAKENFRPAQIPSFQSVVNHSDMDGVLTALVGAGYNSKIKSVGADITKQYRSAMYFVLKEIYYNDFLKLEDIKERFRREALNYKSPQATEKKDPPAESFRARISDLCEDKTITFAEICQQLMTDMQLQQGEMAKKPESKQNVTDKKAYIHFRLILESCIRSAFLDYVKNDGKYAFLLAPMYRKEAFSILKEEEFLPSFKPAKYSALLQGFDAKAESWFVLAHFLRKSELNHLIGAMKGYIEYTENIDRRAKYLSGERFNVSKKREDYKSIIPILEFVMNFNGQISNTITDYFDSEEEYADYLNSFILFAEEKDDKKIALKNFCNLPAPGSPTGKIGIFYDEQNPILNRNVVLSKMYGIDELFIGVYRKNRIKLSDYQSYYRLSKELESVFKSGVCKSEDEVKKLKKFQHMKNRVEMTDIATFTGIVNDLYSQLISWTYLRERDFMYYLLGYYYVKLYQTESVQNDSPLRTITSSDVSKAFSIQNGAVLYQIVAMNTPGLPLIVFEKDGKPSLDTANAANGTGIKVVRFVLDYLGGEETYSDVLAFFGNYKKNNDDVVKMRNYIDHFSYFAGYERSLMDLYSDFFDRFFEYDQKLHKSVSFVFKNILLRYFVISDLNFVSVYRYSYKDKKEGTDKCCGLELKKERKGGDLSLKADNVTIKYKNQNDPQKVQVFARDDEFLSRLEGILTYKRGESR

SEQ ID NO: 2253 - protein, 526 aa, Unknown
  Description of Unknown: uncultivated organism sequence
  Category: MG81 effectors
  Description: MG81-532 effector
MAKNNNNNTDTCVLTLPLRVEKWQEDCLLKRFEAARRIYNSLLNFELKKLRQLECTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2254 - protein, 508 aa, Unknown
  Description of Unknown: uncultivated organism sequence
  Category: MG81 effectors
  Description: MG81-533 effector
MADKECCVLTLPLQTEIWQEHIIEKRFAIMEHLKNQLIAKELRRLKNLERTKEYRNLIDEINNTPKEKRKALFSKRRKLLKDSGFSEYDFKDDIAGKNSLMQKHFIEHIATQIAHKLASDVWRSFDKFLFGNGRFIHFSKRGSLRSVASQKNGNGMTYKNGYFIWNGGQSKNKIILKIKVTPPKNEYEKEMLSKKIKYLRIVKKWVKTRYKYYLQFALEGKPVKKDRIVNKGNVGIDIGTQTVAISSADSVKILELADKIDKNHTKKKILQRKMDRSRRYTNPQNYNEDGTIKKPPKGQRFSWYKSKKYIQLAGKVRELERKNADIRKYQHACLANWILSLGDTVYVEQMNFSGLQRRAKETKIDKNGKYAKKKRYGKSLANKAPSMFLTILGSKLNQYGGQLNKINTYEFKASQYDHTDDTFTKHNRSERWHILSNGDKNQRDLYSAFLIMNSDISLKHCNRKKCNETYSNFKVLQDKEIERLYSDIRKGNCKNISSFGFQRNAKAM

SEQ ID NO: 2255 - protein, 540 aa, Unknown
  Description of Unknown: uncultivated organism sequence
  Category: MG81 effectors
  Description: MG81-534 effector
MATTDKKDEENLRAYKFRLDPNQAQTTALYQAVGAARYTYNMLTAYNLEVNRLRDDYWKRRHDEDISDADIKKELNALAKEDKRYKQLNYGAFGTQYLTPEKKRHEQAEHRIENGEDPSVVWNQETERSANPWLHTANQRVLVSGLQNASDAWDNFWASRTGKRAGRLVGTPRFKKKGVSRDSFTVPAPEKMGAYGTAYLRGEPAYKQGRRKITDYRHVRLSYLGTIRTFNSTKPLVKAVVAGAKIRSYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATEYTLVGFEDLNVSGMTASAKGTVENPGKNVAQKSGLNRVVLDAAFGVFRNQLEYKAVWYGSAFEKVDRYFASSQTCSECGRKAKTKLTLRDRVFDCAYCGNMMDRDLNAAVNICREAQRLFDEKLASEDRESLNGRGSRGALRGAETVEASRPPASHRRGSP

SEQ ID NO: 2256 - protein, 522 aa, Unknown
  Description of Unknown: uncultivated organism sequence
  Category: MG81 effectors
  Description: MG81-535 effector
MANNNNNTDTCVLTLPLRVEKWQEDCLLKRFEAARRIYNSLLNFELKKLRQLERTVEYRQIQSVISSAYRSNTKDSPECKAALKRREKLIDANDLTEYGFKSDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKNLSERWNYMPISDGSDSSKTKRIQRDLYSAFLLQHTIPQSCSFDKEALRIDYPNFVTMHDAEIHRLESQNDHKHGCSAKS

SEQ ID NO: 2257 - protein, 521 aa, Unknown
  Description of Unknown: uncultivated organism sequence
  Category: MG81 effectors
  Description: MG81-536 effector
MMVTWKEGIPVGKSSTDTCCLTLPLKLEKWQEDRLAKRFEIARQIYNTMVRAELKKLERVKQLPEYRKNQKEIQTLDGKNSADRARLKELYGNQRKILQKQGFTEYGFKADSKDYYKHFIENIGSSVATHGIAPQVWNAFDKMLFQKDGKVVHFKRYGDVHSLKGGSVAHKSGGAEIMFRKTYIEWKGLKLPLKLSPNNAYEAEMLSYRVKYVRILRTRGKTKDRWYAQLSLEGKPAVKYDSSTGKPVHPVGRGAVGLDIGPQTLAYAAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEKTGRIKRKKRFGKSVANKAPASLIGILRLKCISLGLTGVVEVPMLLKASQYNHQSKDCAKKSLSQRWNDMPDGNRIQRDLYSAFLLQHYDSQSESFDQETLERDYPQFVRLHNQTIQRLSALPKTPSSMGIRRSVS

SEQ ID NO: 2258 - protein, 522 aa, Unknown
  Description of Unknown: uncultivated organism sequence
  Category: MG81 effectors
  Description: MG81-537 effector
MKKSSTDTCCLTLPLKLEKWQSDRLEKRFEIGRQIYNTVVRAELKKLQQVERTPQYREIEQKLKGAKQEEAKELWKKRTQLLSQSGFSEYGFKSDMKYYYQHFKENIGSSVAVHGIASQVWTAFEKVLFSKDGKMVHFKKKGELSSLRGFSQAGKSGGVEIIFRGSYVEWKGLKLPLKLSPDNDYETEMLSKRVKYVRILRQDGKTKPHWYAQLVLEGKPAIKRDPASGAPKHPIGHGVVGIDIGTRTLAYSADSKVDLIELADRVQNIEQEKMLLQRKLDRSRRATNPGNYNPDGTIKCGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRIIS

SEQ ID NO: 2259 - protein, 495 aa, Unknown
  Description of Unknown: uncultivated organism sequence
  Category: MG81 effectors
  Description: MG81-538 effector
MAGKSDKARCVLTLPLLTEPWQEHIIEKRFRIMEHLKNSLIALELRKLKNIQRTKQYRQLKAEISNAPKENRKTLDKKRKELLINAGFSERAFKDDMTNMQKHFVEHISTHAAHKSASDVWRSFDKVLFHTGRKIHFIRRGSLSSIACQTDGNGMRFRNGMLHWNGGRCKNKVKLELRVACPKTPYECAMLEKKIKFERIIRKWVKTRYKYYVQFTLVGNAVPKPRKTGTGRVGIDIGPSSIAIASSQEVRLMELADKINQNHLRKVALQQKMDRSRRATNPDNFNENKTIRRGVKLSWHYSKHYQKLRGQVRELERKNADIRKYQHTCLANYILSLGTEVYIEQMNFKGLQARAKETTYNKNGRANRKKRFGKSIANRAPAMLVTILETKLKSYAGTELHKVNTWSYRASQYDHITDTYTKKLLRQRWAELGNGDRIQRDLYSAFLLMNSQPSLQSTDRERCSKTYSQFKSLHDQEIYRLQQTPERHLSSFGIA

SEQ ID NO: 2260 - protein, 538 aa, Unknown
  Description of Unknown: uncultivated organism sequence
  Category: MG81 effectors
  Description: MG81-539 effector
MDNEEKEKDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2261 - protein, 538 aa, Unknown
  Description of Unknown: uncultivated organism sequence
  Category: MG81 effectors
  Description: MG81-540 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADHVQNIEQEKRRLQRKMDRSRCATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2262 - protein, 482 aa, Unknown
  Description of Unknown: uncultivated organism sequence
  Category: MG81 effectors
  Description: MG81-541 effector
MDQRELRGLRTYALYCIVAAALLAVVFLFYFSRTKQNIQEQAEAQLTEVTRQYANAIKADMRGNIQTVEALAHVFGELGQGNPETIIPLITGAVGTLRLKRMGFVTLDGMAHTTDGLTFDARDRLYFKRALTASPTVAILLVDKTDNTPINVYVSPIVHKGKVLGALFATVQTDAFIMSIDDRLFNGSGQVLVTNNQGHILFRGRGPIQLARYNNIAELIPTGAPAATGNDINDISDTFGSGGLFRYDGSPYYMAHSKLEITSTDWHIFSIVPEDTLTANVGTIQREVLYLMLFFIGLSMVFLWLVLRMQGRQAKRLRRAKQFLETVIENIPGGFFRYSNDEKQEFDYISEGFLKLLGHTRASFREAYGNRFDNLVHPEDRKRVLDSINSQIKHSDYDTVEYRVTKADGRILWLFDKAQLVRDENGRHRHGHHVPAQYAAGTQNQRGALPYPHRAFRAHHLRTRPRNPLLLFLSPLQGKIRL

SEQ ID NO: 2263 - protein, 534 aa, Unknown
  Description of Unknown: uncultivated organism sequence
  Category: MG81 effectors
  Description: MG81-542 effector
MGWKSKGRGGTLVKKSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKNNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSADSKVDLIELADRVQNIEQEKMLLQRKLDRSRRATNPENYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRIIS

SEQ ID NO: 2264 - protein, 546 aa, Unknown
  Description of Unknown: uncultivated organism sequence
  Category: MG81 effectors
  Description: MG81-543 effector
MANVVYITFGFFRLIMTGLLQPNKNDGIFFQYYQCEVRWAPLAKATTDTCCLTLPLKLEKWHADRLEKRLEIARQIYNTLLRFELKKLHRLEESTEYIDIQNLLKETTDNVERNKLYKQLNKLRQDAGFSEYTFKADIKDFYKHFNNNIGSSVAVHGIAPQVWTAFDRLFYGSGKVVHFKKRGELTSLRGYSVAGKSGGVEIIFRGTYIEWKGLKLPIKLDPKNEYENEMLRQRIKYCRIIKKPGRSKNHWYVQLMLEGKPVIKVNKNTGELLHPVGKGAVGIDIGPQTIAYVSEKEVALKELADQINNIEQEKRVLQRKLDRSRRAMNPGNYEADGTIKRGVKLTRNKSKRYIKTQCELAYLLRRQADIRKRQHNELANHLLSLGDRFYVEDMEWPALAHRAKKTEISEKTGKFKRKKRFGKSIGNKAPSTLIGLLDLKLKSRGLEGVMRVDTKVRASQYNHLTDDYKKKELSERWNNMPDGRRIQRDLYSAFLLQHMNETQTDFDKDALIRDYEQFTVFHDQCIEELRRAPKTLASMGLVRRAS

SEQ ID NO: 2265 - protein, 341 aa, Unknown
  Description of Unknown: uncultivated organism sequence
  Category: MG81 effectors
  Description: MG81-544 effector
MLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKNSQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2266 - protein, 511 aa, Unknown
  Description of Unknown: uncultivated organism sequence
  Category: MG81 effectors
  Description: MG81-545 effector
MAKCSTDTCCLTLPLRLEKWQEDRLAKRFEIARQIYNTMVRAELKKLRAMEQSEPYKANQEKIQALDWKTQADKQALKALYKERDKLLRDGGFSEYGFKSDIKNYYKHFNNNIGSSVAVHGIAPQVWAAFEKMLFKKEGKKVHFKKKGDIRSLRGYSATGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHRDAVLRLYAMPKTPSSMGIKRSLR

SEQ ID NO: 2267 - protein, 313 aa, Unknown
  Description of Unknown: uncultivated organism sequence
  Category: MG81 effectors
  Description: MG81-547 effector
MVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVRRGTKGHKLKWNKSKHYLEIAGKIRELERKNSDIRKYQHTCLANDILAMGNQIYIEPMNYKGLQKRAKETQVDEKGRYKKKKRFGKSLANKAPSMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 2268 - protein, 512 aa, Unknown
  Description of Unknown: uncultivated organism sequence
  Category: MG81 effectors
  Description: MG81-548 effector
MKKSNTDTCCLTLPLKLEKWQEDRLAKRFEIARQLYNTLVHAELKRLAQVKQTAEYRENERKIRALDWNDPGDQTKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKHCLQRKMDRSRRATNPDNYAEDGTIRRGVKLTHNKSKRYRRSQQELKYLQHRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALLKTPASMGIRRSIA

SEQ ID NO: 2269 - protein, 429 aa, Unknown
  Description of Unknown: uncultivated organism sequence
  Category: MG81 effectors
  Description: MG81-549 effector
MLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2270 - protein, 538 aa, Unknown
  Description of Unknown: uncultivated organism sequence
  Category: MG81 effectors
  Description: MG81-550 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISSAPKHPVGHGVVGIDIGTRTLAYSADNKVDLIELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2271 - protein, 522 aa, Unknown
  Description of Unknown: uncultivated organism sequence
  Category: MG81 effectors
  Description: MG81-551 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQTGKSGGIEIIFRGSYVEWKGLKLPLKLSPDNDYETEMLSKRVKYVRILRQDGKTKPHWYAQLVLEGKPAVKRDPISGAPKHPIGRGVVGIDIGTRTLAYSADSKVDLIELADRVQNIEQEKLLLQRKLDRSRRATNPENYKPDGTIKKGVKLTRNKSKRYRRIQHQLAMIQHHQADIRKQQHNELANYLLTLGDCFFVEDMDYRALTRKAKKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2272 - protein, 505 aa, Unknown
  Description of Unknown: uncultivated organism sequence
  Category: MG81 effectors
  Description: MG81-552 effector
MAKATTDTCCLTLPLKLEKWQADRLEKRLEIARQIYNTLLHFELKKLRRLEESKEYIEIQNLLKETTDHAARKGLFKQLNELRRAAGFSEYTFKSDIKDYYKHFKDNIGSNVAVHGIAPQVWAAFDRLFYGNGKSVHFKQRGELTSLRGYSVAGKSGGVEIIFRETLIEWKGLKLPIKLDSKNAYENEMLQQRVKYCRIVKRPGKTASRWYVQLMLEGRPVLKVDRRTGELRHPVGQGAVGIDIGPQTIAYVADGEVALKELADQLGNIEREKRVLQRRLDRSRRATNPNNYAPDGTIKRGTKLTRNKSKRYLKSQRELSFLLHRQAELRKRQHNELANHLLSLGDRFYVEDMEWPALTHRAKETEISEKTGKYKRKKRFGKSVGNKAPAMLLGLLDIKLKSRGLEGVVKVPTSVRASQYNHLTDDYRKKELGERWNTMPDGRRIQRDLYSAFLLQHMNEARSDFDKTALSADYERFVTLHDQCIEELRRAPKTLASMGLVRRAR

SEQ ID NO: 2273 - protein, 511 aa, Unknown
  Description of Unknown: uncultivated organism sequence
  Category: MG81 effectors
  Description: MG81-553 effector
MKRSGTDTCCLTLPLRLEKWQEDRLAKRFEIARQIYNTMVRTELKKLRKMELSQTYRSIQEQIQALDWKNQNDKQQLRSLYNERDQLLKKNGFTEYGFKSDIKYYYKHFNDNIGSSVAVHGIAPQVWAAFEKMLFRKEGKKVHYKKRDDIHSLRGYSVTGKSGGAEIIFRETYIEWKGLKLPLKLSPHNAYETEMLSRRVKYVRLLRKPGKRKDRWYAQLSLEGKPAIKHDPASGELRHPVGRGAVGLDIGPQTLAYSACCAADLVELADRVQNIEQVKRLLLRKMDRSRRTTNPDNYTDDGTIRRGVKLTHNKSKRYQRTQRELRYLQHCQAEMRKRQHIELANHLLTLGDRFYVEDMAWPSLTRRAKETAISEKTGTIKRKKRFGKSIANKAPAALIGILEQKCYSLGLPGVVKVPTSLKASQYNHQSGEYTPKPLSQRWNNMPDGERIQRDLYSAFLLQHYDSQTGNFDPVLLQQDYPQFVQYHHCAIQRLSAMPRTLSSMGIQRSLR

SEQ ID NO: 2274 - protein, 505 aa, Unknown
  Description of Unknown: uncultivated organism sequence
  Category: MG81 effectors
  Description: MG81-554 effector
MARSTSDTCCLTLPLKIEKWQADRLEKRLEIARQIYNTLLRFELKKLKQMEAREDYLAIQEQLKETKNDAERKKLYKQIEKIRSETGFSEYSFKTDIKAFYKHFQENIGSSVAVHGIASQVWIAFDKLFHGSGKAVHFKKRGELTSVRGYSVAGKSGGIEIIFRNTFIEWKGLKLPIKLDPSNAYETEMLQKRVKYCRIIKKPGKNKNHWYVQLSLEGKPAVKYHQQTGEILHPVGHGNVGIDIGPQTIAYVADGEIELKELADQVNNIERKKRVLLRKMDRSRRATNPDNYNPDGTIKRGVKLTKNKSKRYIKCQRQLAHLMRQQAETRKRQHNELANHLLSLGDHFYIEDMEWPSLTHRSTKTEISEKTGKFKRKKRFGKSVGNKAPATLTTLLDLKLKSRGLEGVTKVNTMVRASQYNHITDDYQKKKLSDRWNNMPDGRKIQRDLYSAFLLQHMNETHDGFDKAALCRDYEQFTVLHDQCIKRLEQLKKTIASMGIVRKPS

SEQ ID NO: 2275 - protein, 536 aa, Unknown
  Description of Unknown: uncultivated organism sequence
  Category: MG81 effectors
  Description: MG81-555 effector
MDNEEKKEDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRNEGKTKPHWYAQLVLEGKPAIKRDPASGAPKHPVGHGVVGIDIGTRTLAYSTDSKVDLIELADRVQNTEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQEAFGNEVYRVFDREALQRDYPKFVEYHRETIQRLSALPKTIASMGIRRIIS

SEQ ID NO: 2276 - protein, 554 aa, Unknown
  Description of Unknown: uncultivated organism sequence
  Category: MG81 effectors
  Description: MG81-556 effector
MDNEEKEKDGATCCLTLPLKLEKWQSDHLEKRFEIARQLYNTLVHAELKRIHRIERMPEYREIERQIEATTDKKEKWALKNQKKQFLRKNGINRNTFTTDMKRFYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNIMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2277 - protein, 512 aa, Unknown
  Description of Unknown: uncultivated organism sequence
  Category: MG81 effectors
  Description: MG81-557 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKAHKLKWNKSKHYIEIAGKIRELERKNADIRKYQHTCLANDILAMGNQIYIEPMNYKGLQKRAKETQVDEKGRYKKKKRFGKSLANKAPAMFVTIMKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 2278 - protein, 526 aa, Unknown
  Description of Unknown: uncultivated organism sequence
  Category: MG81 effectors
  Description: MG81-558 effector
MAKKNNNDTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGDISSLKGYSVKGKSGGLEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLKASQYNHLSDTYEKKSLSERWNYMPISDGSDSSKTKRIQRDLYSAFLLQHTIPQPCSFDKEALRIDYPSFVTMHDAEIHRLESLPKTITSMGVRRSHS

SEQ ID NO: 2279 - protein, 522 aa, Unknown
  Description of Unknown: uncultivated organism sequence
  Category: MG81 effectors
  Description: MG81-559 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHSVGHGVVGIDIGTRTLAYSTDSAVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKTPAMLITMLKQKCQSRGLEGVKEVDTHVCASQYNHQTDTCIKKALENRWNIMPDGERIQRDLYSAFLLQHCRRDLPEYNGKELQKEFGEELYRVFDREALQRDYPQFVAYHHMTIQRLSELPHTIPSMGIRRIIS

SEQ ID NO: 2280 - protein, 526 aa, Unknown
  Description of Unknown: uncultivated organism sequence
  Category: MG81 effectors
  Description: MG81-560 effector
MNNEEKEKDGATCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQAGKSGGIEIIFRGSYVEWKGLKLPLKLSPDNDYETEMLSKRVKYVRILRKDGKTKTHWYAQLALEGKPAVKRDSISGAPKHPVGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2281 - protein, 341 aa, Unknown
  Description of Unknown: uncultivated organism sequence
  Category: MG81 effectors
  Description: MG81-561 effector
MLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2282 - protein, 554 aa, Unknown
  Description of Unknown: uncultivated organism sequence
  Category: MG81 effectors
  Description: MG81-562 effector
MDNEEKKEDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGKPAIKRDPASGAPKHPVGHGVVGIDIGTRTLAYSADSKVDLIELADRVQNIEQEKMLLQRKLDRSRRATNPENYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRSIS

SEQ ID NO: 2283 - protein, 484 aa, Unknown
  Description of Unknown: uncultivated organism sequence
  Category: MG81 effectors
  Description: MG81-563 effector
MAKNNNNNDTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDCFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSASTHDTAALFF

SEQ ID NO: 2284 - protein, 511 aa, Unknown
  Description of Unknown: uncultivated organism sequence
  Category: MG81 effectors
  Description: MG81-564 effector
MAKCSTDTCCLTLPLRLEKWHEDRLAKRFEIARQIYNTMVRAELKKLRAMEQSEPYKANQEKIQALDWKTQADKQALKALYKERDKLLQDGGFSERGFKSDIKNYYKHFNNNIGSNVAVHGIAPQVWAAFEKMLFKKEGKKVHFKKKGDIHSLRGYSVTRKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2285 - protein, 497 aa, Unknown
  Description of Unknown: uncultivated organism sequence
  Category: MG81 effectors
  Description: MG81-565 effector
MAKNEQNCCVLTLPLLTEPWQEHIIETRFDIVEKLKNTLIGFELRKLKQLERTRAWKRLMKSIRECSDEKQKKSLFKERNTMLKDAGFTEFGFSGDVTKLAVHKHFVPHIGANIAQRSGQDVWRSFEKYLFSNGKAVHFHKRGSLDSIACKKPRGDGMTIDSDVFTWKGGRCDDCVILKIRIRRPKNAYEREMIQKEIRNMRVVRKWIKTRYKYYLQITYQGAPVSKHRPVGKNRVGIDIGTQTIAWSSPTEVRLAELAAGIRRNHAEKTALQRKMDRSRRTANPQNYNPDGTIKRGIKLRWVKTKHYLRMEGRVRELERKNADIRKNEHICLANHILSLGKEVYIEDMNFKGLQGRAKETKVDKNGRFARKKRFGKSLANRAPSMFVTILENKLKSAGGNLYKVNTRTFKASQYDHTADEYRKKTLGQRWNHLKNGDKIQRDLYSAFLLMNAAPTLEEPDKKLCKKTYPQFALLHDAEMERLNAEEKPHLSSMGIR

SEQ ID NO: 2286 - protein, 383 aa, Unknown
  Description of Unknown: uncultivated organism sequence
  Category: MG81 effectors
  Description: MG81-566 effector
MHFKKKGELSSLRGYSQTGKSGGIEIIFRGSYVEWKGLKLPLKLSPDNDYETEMLSKRVKYVRILRQDGKTKPHWYAQLVLEGKPAVKRDPISGAPKHPIGRGVVGIDIGTRTLAYSADSKVDLIELADRVQNIEQEKLLLQRKLDRSRRATNPENYKPDGTIKKGVKLTRNKSKRYRRIQHQLAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIS

SEQ ID NO: 2287 - protein, 1302 aa, Unknown
  Description of Unknown: uncultivated organism sequence
  Category: MG81 effectors
  Description: MG81-567 effector
MKISKVDHIKTGVSELPIESGGMMYYYPGSNSKNVELRKHITQLCNRARNLYNVFVEPKAAKGKSLDKEICNTLNFYFKNYILKRVDDGNNDDGIYNNICTRNFNARPVMINFKEVNVTEINVQNVIDRCLRQSLRKKFAYNEKTFFIPDVIKKIGIVVFAHDKYLNEIKNISKDEAIALIKALREDYTKENMVETVAASIEKQNVPVQISKDGEQLVLSGSFNEKKAYIFEFMKKYASDEKGQDELLKHMRYLMLLYFYGKDTADDALNDDRFGAWNYGITLNEYKEILFSGEAADIRAELDNVPTNMKGKIRNLEDQLVNTIQKAVVAHYKNAIDGDELSDDDKKWVGFISDRVESKLLKICKSKGRDNGYKLTCKYLCEDLWDEWISFMAMKFVDMGKAVYHFAMEDRDAVTTGKTVSFGRVNSNYKNGLSSFDYERIKASDSFSRSLANYVLFAINNFDTSVRTPEERAKNKKEDILSDNSPVISDDAKKHILRFFGGASNYENTEVDTADTNTLFKECKCCLSAARNTSFHFVSGKNRFGDMPVINAIFKVEQSKAGKIYRKRMYSNNVPMFYAVKDIDDFMSSLYTSVRNDPAQIPSFNKVISRKEIYSFISEFILRDNREVLNNTEIAEIFKSSLYFVLKEIYYYDFINQKDIMDRFMKSINNLKAKDRKEQEAHNDFKKRIDQLKADGIGFGELCQEIMTEYNLQNNQKSKKPSAVKVKDKDGNVSVKEIKDDKTIYKHYVMLLYLGIRQAFYDYINEGKYAFLKKPNKRDLPDEEVFISGWTAKMYDSINLNNDVLMSWYITAHFLDQKQLNHLIGQFKTYVSYIDGIEKRAGATGNKQVKESEDNKKLYIDMITLLEFVKLYCGSVSNKIEDYFENADDYAKYIAGFVDFGGEDKNALQAFCNKKYKFEGDSVTLGKYFDAMNPILDRNVVLASMYGDRELLSAVADKVNEKEITKFYKLKEKAVEIMSENTSEPGELRKLREYQNLKNRIELVDVLSLTELTTALMSQLVGYTALRERDLMYMQLGYYYTKLFHTDSVEKDSYLRKLKGDCDIEDGAVLYQIAAMYSYDLPLYERDEDGISHAPKKPVSIGNKVKKFSEAYCRESKEAGNEYEIYKAGLNLFENISGKKDGRHDEYVDFRIYIDHLKYFAYHDMSILQMYSKLYGGFFSYSTKLRKSVSYVMPNILLSDFVNVKLGFDYKEEGMGDVTYRIPDIVIKEISSDYLSYKEFKSIVSSGNEVLKDGKRFVITGDFVNKNAKKPRKDNKPVSVPARSKSYLDAVSRLLAYRTDMK

SEQ ID NO: 2288 - protein, 530 aa, Unknown
  Description of Unknown: uncultivated organism sequence
  Category: MG81 effectors
  Description: MG81-568 effector
MILLANNNNNNNTDTCVLTLPLRVEKWQEDCLLKRFEAARRIYNSLLNFELKKLRQLERTVEYRQIQSVISSAYRSNTKDSLECKDAFKRRKKLTDENGISEYGFKSDVKFFYKHFDGLIGSSVAVHCIAVQLWAAFDKYLRGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2289 - protein, 538 aa, Unknown
  Description of Unknown: uncultivated organism sequence
  Category: MG81 effectors
  Description: MG81-569 effector
MNNEEKEKDGATCCLTLPLKLEKWQSDHLDKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2290 - protein, 511 aa, Unknown
  Description of Unknown: uncultivated organism sequence
  Category: MG81 effectors
  Description: MG81-570 effector
MAKCSTDTCCLTLPLRLEKWQEDRLAKRFEIARQIYNTMVRAELKKLRAMEQSEPYKANQEKIQALDWKTQADKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPNNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVKYHHDAVLRLYAMPKTPSSMGIKRSLR

SEQ ID NO: 2291 - protein, 522 aa, Unknown
  Description of Unknown: uncultivated organism sequence
  Category: MG81 effectors
  Description: MG81-571 effector
MKRSSTDTCCLTLPLKLEKWQSDRLEKRFEIGRQIYNTVVRAELKKLQQVERTPQYREIEQKLKGAKQEEAKELWKKRTQLLSKSGFSEYGFKSDMKYYYQHFKENIGSSVAVHGIASQVWTAFEKVLFSKDGKMVHFKKKGELSSLRGYSQAGKSGGVEIIFRGSYVEWKGLKLPLKLSPDNDYETEMLSKRVKYVRILRQDGKTKPHWYAQLVLEGKPAIKRDPASGAPKHPVGHGAVGIDIGTRTLAYSADSKVDLIELADRVQNIEQEKLLLQRKLDRSRRATNPENYKPDGTIKKGVKLTRNKSKRYRKIQHQLAMLQHRQANIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNEVYRVFDREALQRDYPKFVEYHRETIQRLSALPKTIASMGIRRIIS

SEQ ID NO: 2292 - protein, 538 aa, Unknown
  Description of Unknown: uncultivated organism sequence
  Category: MG81 effectors
  Description: MG81-572 effector
MDNEEKKEDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPVGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDICIEKALENRWNVMPDGERIQRDLYSAFLLQHCKQGLPEYNRKELKKEFGEELYRVFDREALQRDYPQFVAYHHMTVQRLSELPHTIPSMGIRRIIS

SEQ ID NO: 2293 - protein, 595 aa, Unknown
  Description of Unknown: uncultivated organism sequence
  Category: MG81 effectors
  Description: MG81-573 effector
MVDLKKQLCSSASNSENQGVRFQTVVLYTKFVHKSVQLSPESSVFAVALFVRMMYNTKYQAKRGDPVGEKKNNNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2294 - protein, 511 aa, Unknown
  Description of Unknown: uncultivated organism sequence
  Category: MG81 effectors
  Description: MG81-574 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLKGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDSKAGNFDSALLQQDYPQFVQYHHRAIQRLSTVPKTLSSMGIQRSLR

SEQ ID NO: 2295 - protein, 511 aa, Unknown
  Description of Unknown: uncultivated organism sequence
  Category: MG81 effectors
  Description: MG81-575 effector
MGKSSTDTCCLTLPLKLEKWQEDRLAKRFEIARQIYNTMVRAELKKLERVKQLPEYRKNQKEIQALDWKNSADKQRLKELYGNQRKILQKQGFTEYGFKADSKDYYKHFIENIGSSVATHGIAPQVWNAFDKMLFQKDWKVVHFKRHGDVHSLKGGSVTHKSGGAEIMFRKTYIEWKGLKLPLKLSPNNAYEAEMLSYRVKYVRILRTRGKTKDRWYAQLSLEGKPAVKYDSNTGKPVHPVGRGAVGLDIGPQTLAYAAADEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEKTGKIKRKKRFGKSVANKAPASLIGILKLKCISLGLTGVVEVPMLLRASQYNHQSKDYEKKSLSQRWNNMPDGNRIQRDLYSAFLLQHYDSQSESFDQETLERDYPQFVRLHNQTIQRLSALPKTPSSMGIRRSVS

SEQ ID NO: 2296 - protein, 512 aa, Unknown
  Description of Unknown: uncultivated organism sequence
  Category: MG81 effectors
  Description: MG81-576 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSAFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2297 - protein, 529 aa, Unknown
  Description of Unknown: uncultivated organism sequence
  Category: MG81 effectors
  Description: MG81-577 effector
MILLAKKNNNDTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2298 - protein, 511 aa, Unknown
  Description of Unknown: uncultivated organism sequence
  Category: MG81 effectors
  Description: MG81-578 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLKGKPAIKRDPESGERRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDSKAGNFDSALLQQDYPQFVQYHHRAIQRLSTVPKTLSSMGIQRSLR

SEQ ID NO: 2299 - protein, 511 aa, Unknown
  Description of Unknown: uncultivated organism sequence
  Category: MG81 effectors
  Description: MG81-579 effector
MAKKSATDTCCLTLPLLTEKWQSDRLEKRFEIARQIYNTLLNYELKKLRRLEQSAEYTAIQAAIQKSYEAGKTDKAELKSLFQEREKLRRAAGFSEYDFKTDIKTFYKHFNDNIGSSVAVHGIAPQVWQGFDQLFYGNGKAVHFKRRGDIKSLRGYSVAGKSGGVEIIFRGSYIEWKGLKLSLKLGKNNAYEAEMLQKRVKYCRIVKKAGKHKTHWYVQLMLEGTPAQKCDVNTGELRHPVGRGAVGIDIGPQTIAYAAEAEVALKELADGVKNIEQEKRLLQRKLDRSRRSTNPDNFAADGTIKRGVKLNWHKSKRYIRLQHELAVLQRQQAEVRKRQHTELANHLLSLGDRFYVEDMEWPALTHRAKETAISEKTGRYKRKKRFGKSVANKAPAMLIAILDQKLRSRGLDGVIKVKTSVRASQFNHMTGEYQKKSLAQRWNDMPDGRRIQRDLYSAFLLQHMNAAQDGFDVAALNRDYENFAVLHKRVIEELRTASKTLSSMGITRSVS

SEQ ID NO: 2300 - protein, 587 aa, Unknown
  Description of Unknown: uncultivated organism sequence
  Category: MG81 effectors
  Description: MG81-580 effector
MRNGNKPTDGLLWYPRRAVFDTSHQKRPCALRGGTGEYDVGWARSRWRTALTTGTGACHAPVGGGERTDSPTEVGRHPDAFEVTLPRLFAFGFGCGGFVLGEAFMADHRKIYNTMVRAELKKLDRVKQLPEYRKNQKEIQALDWKNSADKQRLKEQYGNQRKILQKQGFTEYGFKADSKDYYKHFIENIGSSVATHGIAPQVWNAFDKMLFQKDGKVVHFKRYGDVHSLKGGSVAQKSGGAEIMFRKTYIEWKGLKLPLKLSPNNAYEAEMLSYRVKYVRILRTRGKTKDRWYAQLSLEGKPAVKYDSNTGKPVHPVGRGAVGLDIGPQTLAYAAANEANLVELADQVQNIEQEKRRLQRKLDRSRRATNPDNYNENGTIRKGVKLTHNKSKRYCKLQKELSWIQHYQAETRKRQHIALANHLLSLGDCFYVEPMAWPSLTHRAKKTEISEKTGKIKRKKRFGKSVANKAPASLIGILKLKCISLGLTGVVEVPMLLKASQYNHQSKDYAPKSLSQRWNDMPDGNRIQRDLYSAFLLQHHDSQSESFDQETLERDYPQFVRLHNQTIQRLSALPKTPSSMGIRRSVS

SEQ ID NO: 2301 - protein, 525 aa, Unknown
  Description of Unknown: uncultivated organism sequence
  Category: MG81 effectors
  Description: MG81-581 effector
MANNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSNVAVHCIAVQLWAAFDKYLRGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2302 - protein, 499 aa, Unknown
  Description of Unknown: uncultivated organism sequence
  Category: MG81 effectors
  Description: MG81-582 effector
MLTAYNLEVNRLRDDYWKRRHDEDISDADIKKELNALAKEDKRYKQLNYGAFGTQYLTPEKKRHEQAEHRIENGEDPSVVWNQETERSANPWLHTANQRVLVSGLQNASDAWDNFWASRTGKRAGRLVGTPRFKKKGVSRDSFTVPAPEKMGAYGTAYLRGEPAYKQGRRKITDYRHVRLSYLGTIRTFNSTKPLVKAVVAGAKIRSYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATEYTLVGFEDLNVSGMTASAKGTVENPGKNVAQKSGLNRVVLDAAFGVFRNQLEYKAVWYGSAFEKVDRYFASSQTCSECGRKAKTKLTLRDRVFDCAYCGNMMDRDLNAAVNICREAQRLFDEKLASEDRESLNGRGSRGALRGAETVEASRPPASHRRGSP

SEQ ID NO: 2303 - protein, 538 aa, Unknown
  Description of Unknown: uncultivated organism sequence
  Category: MG81 effectors
  Description: MG81-583 effector
MNNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDSISGAPKHPVGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2304 - protein, 511 aa, Unknown
  Description of Unknown: uncultivated organism sequence
  Category: MG81 effectors
  Description: MG81-584 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGERRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLHGVMKVPTSLRASQYNHQSGEYTSKPLSQRWNNMPDGERIQRDLYSAFLLQHYDPKAGNFDSALLQQEYPQFVQYHHRAIQRLSAVPKTLSSMGIQRSLR

SEQ ID NO: 2305 - protein, 538 aa, Unknown
  Description of Unknown: uncultivated organism sequence
  Category: MG81 effectors
  Description: MG81-585 effector
MNNEEKEKDGATCCLTLPLKLEKWQSDHLEKRFEIARQLYNTLVHAELKKKCQVERMPEYQEIMKMIDAASNQKEKWALEKKRKAFLEENGFNRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDSASGAPKHPVGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDICIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2306 - protein, 522 aa, Unknown
  Description of Unknown: uncultivated organism sequence
  Category: MG81 effectors
  Description: MG81-586 effector
MKRSSTDTCCLTLPLKLEKWQSDRLEKRFEIGRQIYNTIVHAELKKLRKLERTQQYQEIEQKLENAKQEETKELWKKKRQLLDQNGLSEDHFKADMKYYYPHFKDNIASNVAVHGIASQAWTAFEKVLFSKDGKMVHFKKKGELSSLRGYSRAGKSGGVEIIFRGSYVEWKGLKLPLKLSPDNDYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVEDMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2307 - protein, 508 aa, Unknown
  Description of Unknown: uncultivated organism sequence
  Category: MG81 effectors
  Description: MG81-587 effector
MADKECCVLTLPLQTENWQEHIIEKRFAIMEHLKNQLIAKELRRLKNLERTKEYRILIDEINNTPKEKRKALFSKRRKLLKDSGFNRNKFKDDMAVMQKHFEEHIATQIAQEAASDVWRSFDKYLFNNGKYIHFTRKGSLSSINCQKINNGMKYIDGYFIWTCGICSGKRDRRIILKIKVTPPKNEYEKEMLSKKIKYLRIVKKWVKTRYKYYLQFALEGKPVKKDRIVNKGNVGIDIGTQTVAISSADSVKLLELADKIDKNHTKKKILQRKMDRSRRYTNPQNYNEDGTIKKPPKGQRYCWYKSKKYIQLAGKVRELERKNADIRKYQHTCLANWILSLGDTVYVEQMNFSGLQRRAKETKIDKNGKYAKKKRYGKSLANKAPSMFLTILESKLNQYGGQLNKINTYEFKASQYDHTDDTFTKHNRSERWHILSNGDKNQRDLYSAFLIMNSDISLEHCNREKCNETYSNFKVLQDKEIERLYSDIRKGNCKNISSFGFQRNAKAM

SEQ ID NO: 2308 - protein, 534 aa, Unknown
  Description of Unknown: uncultivated organism sequence
  Category: MG81 effectors
  Description: MG81-588 effector
MGWKSKGRGGTLVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLKLSPDNDYETEMLSKRVKYVRILRKDGKTKTHWYAQLALEGKPAVKRDSISGAPKHPVGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2309 - protein, 521 aa, Unknown
  Description of Unknown: uncultivated organism sequence
  Category: MG81 effectors
  Description: MG81-589 effector
MLILGRRMYMPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2310 - protein, 512 aa, Unknown
  Description of Unknown: uncultivated organism sequence
  Category: MG81 effectors
  Description: MG81-590 effector
MPTKQKEGGNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTDRVGIDIGTQTIAVASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2311 - protein, 511 aa, Unknown
  Description of Unknown: uncultivated organism sequence
  Category: MG81 effectors
  Description: MG81-591 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKFSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2312 - protein, 359 aa, Unknown
  Description of Unknown: uncultivated organism sequence
  Category: MG81 effectors
  Description: MG81-592 effector
MKATKTLQLRIKDKHAKVLVAMAREVNQAWNHVNEVSAKAARPFHGKPKYLSGYDLQKCTAGYSKCDGVSVGSGTVQLVCAEYATRRKQFKKTRLNWRISNPKSSKYSLGWIPFKGGHAKYKAGQIHFAGQKFSLWDSYGLSKYELRGGSFTEDSRGRWYFNVAVEVECQPSPATASVGIDLGLKDCATDSNGKQLHGRWYRNHELALAKAQRANKKKRVKTIHAKIKNQRKDDMHQFSTQLVKNNAAIFVGDVASAKLVKTKMAKSTLDAGWSSLKTMLEYKSHQAGIVFEVVSESYSTQTCSCCGAIPASSPKGRAGLRIREWTCSDCGAEHDRDVNAARNILAAGHRRLAEGIPVL

SEQ ID NO: 2313 - protein, 505 aa, Unknown
  Description of Unknown: uncultivated organism sequence
  Category: MG81 effectors
  Description: MG81-593 effector
MAKATSDTCCLTLPLKLEKWQEDRLAKRLKIARQIYNTLLHFELKKLRRLEASEEYLAIQEKLKEVTDKTERNKLYKQLDKLRRDTGFTEYAFKTDIKEFYKHFSDNIGSAVAVHGIAAQVWVAFDKLFYGSGKAVHFKRHGELNSLRGYSVAGKSGGVEIMFRETYIEWKGLKLPIKLDPNNAYEQEMLQYRIKYCRIIRKPEKSKNHWYVQLSLEGKPVIKCNKETGEILHPVGSGAVGIDIGPQTIAYASESEVALKELADQVNNIEQEKRILQRKLDRSRRATNPDNYNPDGTIKRGVKLTRNKSKRYQKCQRELADIQHRQADIRKRQHNELANHLLSLGNRFYVEDMEWPALTHRAKKTEVSEKTGRFKRKKRFGKSIANKAPATLTNLLDLKLKSRGLGGVVHVDTKVRASQYNHLTDDYHKKELNERWNAMPDGRRIQRDLYSAFLLQHMNEKLDGFDKEALTRDYEQFAALHDDCIDALKKAPKTLASMGIVRRTS

SEQ ID NO: 2314 - protein, 1302 aa, Unknown
  Description of Unknown: uncultivated organism sequence
  Category: MG81 effectors
  Description: MG81-594 effector
MKISKVNHVKTGTRIKENNGEGVLYANPSKQANAVKDLSKHIQDVNKKAQGLYSPLNPVKALINPKMPKEKKDEINGSYKAFKSVVNDIIKENEAGIPDSASVIRALYEKAKKTDLKVSDASNLSSKMIDKCLRKSLESKSEIAKEILRAIISSDKSTVNSLNAEEVKAFFELVHKDYYKIEQLKAIEKSIENKDVKVQVKTGNDGEKHLVLSNADNAKKHFYFDFVKEFAAKDKIEREEMIIRFRQLIILFYSGVESYKLSIGSDVGAWTFGSSLPEVTDNFDDEIASLISEYNNNIANKENIQKSIDLKSNQMKNYKFNSPEYKKLDDQISKLKDDQGDCKYAISDAKRKIKVLVEKLICIKYRDAINAEGITDSDVFWIGYIQQVAQKQFSKKDAYNNYRISTKYLYEVTFNEWISFMASKYIDLGKAVYHFAMPDFSDIKSGKEIYAGKVQPIFENGITSFDYERIKAKETLARDFSVYATYASGIFSNAVTDSDYRLKDEKEDALFYKQEDWEQALLPDAKKKLLMYFGGQSKWEDSEIENVSDLEMTKAFQDMINVIRNSNYHYAGSVLEPNEQSTNIAKMLFDKEFSWLGKIIREKYLSNNVPVYYNVEDINKMMTYLYQGESKREAQIPSFGNVLKKKEMPGFVTKYIPGNLLAKFDSAGVDKFRASLYFVLKEAYYYGFLNETNLKGRFIKALNDSEKNAKNPEAIENFKARINDMDDSCSFGEICQMLMTDYNLQNQSEYKVKSQIEQNQDEKDNKGHKYSHFKMLLYITLQKAFIDYIVEKQDIYGYIKAPIFKSNYFDGDEPQKFVESWEANLFGDVKITTETDPYFLAWYVLSHMLPAKQVNQLQGGIKSYIQFVTDINRREKSVIGTEKDDSLVNSIAYYQNILKVLEFVMCFVGKTSNVLSDYFADEDDYALHLYSYVGFASKKEEKTNSTLSGFCSKSITKAGKELTDRIGIYHDGTNPIVNNNVVKALMYGNENVLSEAVTRVSADLINGEITKYYEVKKKLEKVFEKGECSNEEEQKDLREFQNLKNRIELQDISIFTEIINDYMSELVNMAYLRERDLMYYQLGFNYIRLEYGNVEDKYKELQGDNINIKSGALLYQIVALYTHELPIVYKDKDSYKYTNNGKIGRFVKSYCEEEFSDLDNAYLKGLELFEDINLHDDLHLFRNEIDHLKYFIRADKSILQMYSRIYNGFFSYDLKLKKSVSYIFANILAKYFVIADTEMKSSVENGKRVAMLSIKGLESDVFNYKGKKLDKEGKERDSKYTLPVRSDEFLKEIKKLLNYKSI

SEQ ID NO: 2315 - protein, 512 aa, Unknown
  Description of Unknown: uncultivated organism sequence
  Category: MG81 effectors
  Description: MG81-595 effector
MKKSSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKVLFKKGGKKVHYKRPGEVNSVQGYSRTGKSGGREIMFRGAYIEWKGLKLPLKLSPDNAYETDMLQRRLKLVRLVRRPGKRRDRWYAQLVLEGKPAIKADPVTGKAVHPIGSGPVGLDIGPQTLAYSAAGVAGLVELADRVQNIEQEKRCLQRKMDRSRRAANPDNYAEDGTIRRGVKLTHNKSKRYRRSQQELKYLQHRQAEIRKLQHIQLANHLLSLGDHFYVEKMEWSSLTHRAKKTVISEKTGKPRSKKRFGKSIANKTPAMLIEILRQKCKSLGLSDVVEINPADIKASQYNHLTGEYVKKSLSRRWNDMQDGEHLQRDLYSAFLLQHYDSMSKALDLDSLARDYPAFVQYHHREIERLHALPKTPSSMGIRRSIA

SEQ ID NO: 2316 - protein, 355 aa, Unknown
  Description of Unknown: uncultivated organism sequence
  Category: MG81 effectors
  Description: MG81-596 effector
MILVYRYRVKSLNGLLNKQSRAVNFVWNFCNDRQKDALRFGRRWHTGFDLNKLTAGSSKELGLHSGTVNAVCEQYAKSRSQKKRPFLRYRGKRSLGWVPLKGRELKLEGIFFRFACNTFRVFNSRALPEGKIKDGTNFSRDSRGNWFLNIVIDVDVVAPDARAPVRGVGIDLGLKDFATLSTGEKIQAQHIYRGAQQALAVAQRANKKKRVKAIHAQIANRRNDFHHKLSTRIVREFDYIAVGNVNAAGLAKTSMAKSVLDAGWSSFRTQLAYKAVKHGAWFEEVNEAFSTQTCSDCGSMPDSRPKGIAGLGIRSWICSVCGGVHDRDVNAAKNILNKLGSRAGHGTPVVGIPVL

SEQ ID NO: 2317 - protein, 522 aa, Unknown
  Description of Unknown: uncultivated organism sequence
  Category: MG81 effectors
  Description: MG81-597 effector
MKKSSTDTCCLTLPLKLEKWQSDRLEKRFEIGRQIYNTVVRAELKKLQQVERTPQYREIEQKLKKAKQEEAKELWKTRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRSIS

SEQ ID NO: 2318 - protein, 512 aa, Unknown
  Description of Unknown: uncultivated organism sequence
  Category: MG81 effectors
  Description: MG81-598 effector
MKKSSTDTCCLTLPLKLEKWQEDRLAKRFEIARQLYNTLVHAELKRLVQIKRTAEYRENERKIRTLDWNNPAHRTELEKLYEERRKSLKKAGFTDNSFTTDMGKYYKHFRDNIGSSVAVHGIAPQVWAAFDKLLFKKGGKKVHCKRPGEVNSVQGYSRTGKSGGREIMFRGAYIEWKGLKLPLKLSPDNAYETDMLQRRVKLVRLVRRPGKRRDRWYAQLVLEGKPAIKADPVTGKAVHPIGSGPVGLDIGPQTLAYSAAGVAGLVELADRVQNIEQEKRCLQRKMDRSRRATNPDNYAEDGTIRRGVKLTHNKSKRYRRNQQELKYLQHRQAEIRKLQHIQLANHLLSLGDHFYVEKMEWSSLTRRAKKTVISEKTGKPRSKKRFGKSIANKAPAMLIEILRQKCKSLGLPNVVEINPADIKASQYNHLTGEYVKKSLSRRWNDMQDGEHLQRDLYSAFLLQHYDSMSKALDLDSLARDYPAFVQYHHREIERLHALPKTPASMGIRRSIA

SEQ ID NO: 2319 - protein, 511 aa, Unknown
  Description of Unknown: uncultivated organism sequence
  Category: MG81 effectors
  Description: MG81-599 effector
MGKSSTDTCCLTLPLKLEKWQEDRLAKRFEIARQIYNTMVRAELKKLDRVKQLPEYRKNQKEIQALDWKNSADKQRLKELRANQNRILQKQGFTEYGFKADSKDYYKHFIENIGSSVATHGIAPQVWNAFDKMLFQKDGKVVHFKRYGDVHSLKGGSVAHKSGGAEIMFRKTYIEWKGLKLPLKLSPNNAYEAEMLSYRVKYVRILRTRGKTKDRWYAQLSLEGKPAVKYDSSTGKPVHPVGRGAVGLDIGPQTLAYAAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEETGRIKRKKRFGKSVANKAPASLIGILKLKCISLGLTGVVEVPMLLRASQYNHQSKDYAKKSLSQRWNDMPDGNRIQRDLYSAFLLQHYNSQLENFDQETLERDYPQFVRLHNQTIQRLSALPKTPSSMGIRRSVS

SEQ ID NO: 2320 - protein, 512 aa, Unknown
  Description of Unknown: uncultivated organism sequence
  Category: MG81 effectors
  Description: MG81-600 effector
MKKSNTDTCCLTLPLKLEKWQEDRLAKRFEIARQLYNTLVHAELKRLAQVKQTAEYRENERKIRALDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEAKPAIKADPVTGKAVHPIGSGPVGLDIGPQTLAYSAAGAAGLVELADRVQNIEQEKRCLQRKMDRSRRAANPDNYAEDGTIRRGVKLTHNKSKRYRRSQQELKYLQHRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPSSMGIRRSIA

SEQ ID NO: 2321 - protein, 528 aa, Unknown
  Description of Unknown: uncultivated organism sequence
  Category: MG81 effectors
  Description: MG81-601 effector
MRRKNVYNNSNMERRDSCGKSSTDTCCLTLPLKLEKWQEDRLAKRFEIARQIYNTMVRAELKKLERVKQLPEYRKNQKEIQALDGKNSADRARLKELRANQNRILQKQGFTKYGFKSDSKDYYKHFIENIGSSVATHGIAPQVWNAFDKMLFQKDGKVVHFKRHGDVHSLKGGSVTHKSGGAEIMFRKTYIEWKGLKLPLKPSPNNAYEAEMLSYRVKYVRILRTRGKTKDRWYAQLSLEGKPAVKFDSSTGKLVHPVGRGAVGLDIGPQTLAYAAADEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRSKKTEFSEKTGKIKRKKRFGKSVANKAPASLIGILKLKCISLGLTGVVEVPMLLRASQYNHQSKDYEKKSLSQRWNDMPDGNRIQRDLYSAFLLQHYNSQSESFDQETLERDYPQFVRLHNQTIQRLSALPKTPSSMGIRRSVS

SEQ ID NO: 2322 - protein, 379 aa, Unknown
  Description of Unknown: uncultivated organism sequence
  Category: MG81 effectors
  Description: MG81-602 effector
MLFHKEGKKVHYKKKDDIHSLRGYSVTGKSGGVEIIFRETYIEWKGLKLPLKRSPDNAYETEMLSRRVKYVRLLRKPGKRKDRWYAQLSLEGKPAIKRDPESGELRHAIGRGAVGLDIGPQTLAYSACGAADLVELADQVQNIEQMKRRLQRKLDRSRRATNPNNYADNGTIRRGVKLTHNKSNRYRRTQRELRYLQHRQAEIRKRQHIELANRLLALGNCFYVEDMAWPSLTHRAKETAISEKTGRIKRKKRFGKSVANKAPATLIGILEQKCNSLGLPGVMKVPTSLRASQYNHQSGEYTSKPLSQRWNDMPDGERIQRDLYSAFLLQHYDPQAGNFNSALLQQDYPQFVQYHHRAIQRLSTAPKTLSSMGIQRSLR

SEQ ID NO: 2323 - protein, 512 aa, Unknown
  Description of Unknown: uncultivated organism sequence
  Category: MG81 effectors
  Description: MG81-603 effector
MPTKQKEGGNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNNIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMLYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2324 - protein, 480 aa, Unknown
  Description of Unknown: uncultivated organism sequence
  Category: MG81 effectors
  Description: MG81-604 effector
MAGKSDKACCVLTLPLLTEPWQEHIIEKRFRIMEHLKNSLIALELRKLKNIQRTKQYRQLEAEISNAPKENRKTLYKKRNELLKNAGFSEFAFIDDMTNMQKHFVEHIATQIAHKSASDVWSSFEKVLFNTGRKIHFIRRGSLSSIACKKDGNGMRFRNGMLHWNGGQCKNKVKLELRVACPKTPYECAMLEKKIKYERIIRKWVKTRYKYYVQFTLDGNAVPKPRKMGTGRVGIDIGPSSIAIASSQEVRLMELADKSFSDQTTNPDNFNENKTIRRGVKLSWHYSKHYQKLRGQVRELERKNADIRKYQHTCLANYILSLGTEVYIEQMNFKGLQARAKETTYNKNGRANRKKRFGKSIANRAPAMLVTILETKLKSYAGTELHKVNTWSYRASQYDHITDTYTKKLLRQRWAELGNGDRIQRDLYSAFLLMNSQPSLQSTDRERCSKTYSQFKSLHDQEIYRLQQTPERHLSSFGIA

SEQ ID NO: 2325 - protein, 550 aa, Unknown
  Description of Unknown: uncultivated organism sequence
  Category: MG81 effectors
  Description: MG81-605 effector
MGWKSKGRGGTLVDNEEKKEDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2326 - protein, 512 aa, Unknown
  Description of Unknown: uncultivated organism sequence
  Category: MG81 effectors
  Description: MG81-606 effector
MPAKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVAPVKTNYEKEMVANNETKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASKCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2327 - protein, 512 aa, Unknown
  Description of Unknown: uncultivated organism sequence
  Category: MG81 effectors
  Description: MG81-607 effector
MKKSSTDTCCLTLPLKLEKWQEDRLAKRFEIARQLYNTLVHAELKRLAQVKQTAEYRENERKIRTLDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKRCLQRKMGRSRRATNPDNYAEDGTIRRGVKLTHNKSKRYRRSQQELKYLQRRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHQEIERLHALPKTPSSMGIRRSIA

SEQ ID NO: 2328 - protein, 525 aa, Unknown
  Description of Unknown: uncultivated organism sequence
  Category: MG81 effectors
  Description: MG81-608 effector
MAKNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2329 - protein, 485 aa, Unknown
  Description of Unknown: uncultivated organism sequence
  Category: MG81 effectors
  Description: MG81-609 effector
MKRFEIARQIYNSLLHAEQKKLRRLEQTPEYREIQRKLQELYREKAEKSRAFREIAKKRTALLKRAGFTEYAFKTDMKAYYKHFKENIGSSVAVHGIASQVWTAFDRKLYGNGKHVHFKRPGEIRSLRGYSAAGKSGGVEILFRGTHIEWKGLCLPLKQKPENAYETEMLSRRVKYVRILRTPGKHRDRWYAQLVLEGRPAVKRNTETGELLHPIGKGPVGIDIGPQTVAYVSQGEASLLELADRVRNIEQEKRKLQRKMDRSRRATNPENYAEDGTIRRGIRLTRNKSGRYRKLQKELAFLQHHQADIRKQQHIALANHLLSLGDRFYVEDMAWPSLTHRAKETVISPKTGRYQRKKRFGKSVANKAPAMFLGILTQKCVSLGLPGVVKVSTSVRASQYNHLTETYQKKPLSQRWNVMPDGRKIQRDLYSAFLLQHMTPQLDGFDPDGLRQDYESFAVLHEEAIHKLRLVPRTLTSMGLQRKCS

SEQ ID NO: 2330 - protein, 531 aa, Unknown
  Description of Unknown: uncultivated organism sequence
  Category: MG81 effectors
  Description: MG81-610 effector
MILLAKNNNNNNNTDTCVLTLPLRVEKWQEDCLLKRFEAARRIYNSLLNFELKKLRQLERTVEYRQIQSVISSAYRSNTKDSPECKDAFKRREKLISVNGISENGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLRASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 2331 - protein, 512 aa, Unknown
  Description of Unknown: uncultivated organism sequence
  Category: MG81 effectors
  Description: MG81-611 effector
MKKSSTDTCCLTLPLKLEKWQEDRLAKRFEIARQLYNTLVHAELKRLAQVKQTAEYRENERKIRALDWNDPGDQTKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRERWYAQLVLEGKPAIKADPVTGKAVHPIGSGPVGLDIGPQTLAYSAAGVAGLVELADRVQNIEQEKRCLQRKMGRSRRATNPDNYAEDGTIRRGVKLTHNKSKRYRRSQQELKYLQHRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALLKTPASMGIRRSIA

SEQ ID NO: 2332 - protein, 511 aa, Unknown
  Description of Unknown: uncultivated organism sequence
  Category: MG81 effectors
  Description: MG81-612 effector
MGKSSTDTCCLTLPLKLEKWQEDRLAKRFEIARQIYNTMVRAELKKLDRVKQLPEYRKNQKEIQALDWKNSADKQRLKELYGNQRKILQKQGFTEYGFKSDSKDYYKHFIENIGSSVATHGIAPQVWNAFDKMLFQKDGKVVHFKRYGDVHSLKGGSVTNKSGGAEIMFRKTYIEWKGLKLPLKLSPNNAYEAEMLSYRVKYVRILRTRGKTKDRWYAQLSLEGKPAVKYDSSTGKPVHPVGRGAVGLDIGPQTLAYAAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEETGRIKRKKRFGKSVANKAPASLIGILKLKCISLGLTGVVEVPMLLRASQYNHQSKDYAKKSLSQRWNDMPDGNRIQRDLYSAFLLQHYDSQSESFDQETLERDYPQFVRLHNQTIQRLSALPKTPSSMGIRRSVS

SEQ ID NO: 2333 - protein, 512 aa, Unknown
  Description of Unknown: uncultivated organism sequence
  Category: MG81 effectors
  Description: MG81-613 effector
MPTKQKEDSNRCVLTLPLLTEPWQEHIIEKRFKIIEHLKNQLISIELRKLKNLQRTKAYKNLIKQIESVPKSERTALYKERNKMLKDTGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKKAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2334 - protein, 528 aa, Unknown
  Description of Unknown: uncultivated organism sequence
  Category: MG81 effectors
  Description: MG81-614 effector
MILLANNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2335 - protein, 528 aa, Unknown
  Description of Unknown: uncultivated organism sequence
  Category: MG81 effectors
  Description: MG81-615 effector
MAKNNNNNNDTDTCVLTLPLRVEKWQEDCLLKRFEAARRIYNSLLNFELKKLRQLERTVEYRQIQSVISSAYRSNTKDSLECKDAFKHREKLISANGISKNGFKSDVKFFYKHFDGLIGSSVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTITSMGVRRSHS

SEQ ID NO: 2336 - protein, 534 aa, Unknown
  Description of Unknown: uncultivated organism sequence
  Category: MG81 effectors
  Description: MG81-616 effector
MILLANNNNNNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 2337 - protein, 542 aa, Unknown
  Description of Unknown: uncultivated organism sequence
  Category: MG81 effectors
  Description: MG81-617 effector
MPKRAEGPRCVLTMPLLTEPWQEHILETRFRIILHLKNQLVRMEWRKYKDLCRTKEFRQLEEQIEATPKEERRPLHKKRRELLKAAGLSEYRFKADISDMQKQFSRHIAVKIAENAASDVWRAFDTYLFKKGQEVHTHSLSMMRSVAGQAGNGMHYIKVTKKGKDYYFFKWNVEKEKEEPTDQKKRPSKKQTRRERIRGKKSIPLKISITPPRNAYEREMLEKPVKYLRVVRRWIKSRYKYYLQFTLEGHPVPKPKERGTGRVGIDIGTRTIAVVSGNEVHLEELVEVTDRDHRRSVDQCQRRKAALRRKMDRSSRIMNPQNFKPDGSVKPRKELTPWKRSNRYKRLAGKVRELERKNADVRKYEHSRLADRILAMGDEIFLESMNFSALQRRKKKTEKDKKGRYAKKKRFGKSIAHRAPATLVSTLERKAAQRHQTVVRVKTETFRASQLDHTTGEYRKTHLSERRKTLSNGDEVQRDLYAAFLLMNSASTWDEKKKEEVWDHSDLDACRESYGTFKVLHDAEILRIANDGRQHPSSFGIA

SEQ ID NO: 2338 - protein, 511 aa, Unknown
  Description of Unknown: uncultivated organism sequence
  Category: MG81 effectors
  Description: MG81-618 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKAVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2339 - protein, 538 aa, Unknown
  Description of Unknown: uncultivated organism sequence
  Category: MG81 effectors
  Description: MG81-619 effector
MDNEEKKEDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIASMGIRRSIS

SEQ ID NO: 2340 - protein, 512 aa, Unknown
  Description of Unknown: uncultivated organism sequence
  Category: MG81 effectors
  Description: MG81-620 effector
MKKSSTDTCCLTLPLKLEKWQEDRLAKRFEIARQLYNTLVHAELKRLAQVKQTAEYRENERKIRALDWNDPGDQTKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKHCLQRKMDRSRRATNPDNYAEDGTIRRGVKLTHNKSKRYRRSQQELKYLQRRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPASMGIRRSIA

SEQ ID NO: 2341 - protein, 523 aa, Unknown
  Description of Unknown: uncultivated organism sequence
  Category: MG81 effectors
  Description: MG81-621 effector
MILLAKNNNNNTDTCVLTLPLRVEKWQEDCLLKRFEAARRIYNSLLNFELKKLRQLERTVEYRQIQSVISSAYRSNTKDSPECKDAFKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTCEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 2342 - protein, 510 aa, Unknown
  Description of Unknown: uncultivated organism sequence
  Category: MG81 effectors
  Description: MG81-622 effector
MAKATTDTCCLTLPLVLEKWQSDRLAKRFELARQIYNTLLNYELKKLRRLEKTEEYAAGQAKLKELNDRQERDEAARKECHRQLNELRKAAGFSEYDFKTDVKPFYKHFGDNVGSSVAVHGIASQVWQAFERLFYGNGKAVHFKKRGEIRSLRGYSVSGKSGGVEIMFRGSYIEWKGLRLPIKLDADNAYEAEMLQKRVKYCRIVRKEGRRKTRWYVQLMLEGKPALKCDPDTGALRHPTGSGPVGIDIGPQTVAYAAETEAVLQELADGVKDIEREKRTVQRKLDRSRRATNPECFAADGTIKRGVKLNWRKSKRYLALQRELASLQRQQAEIRKRQHTELANHLLSLGDRFYVEDMAWPALTHRAKETAISEKTGRYKRKKRFGKSVGNKAPAMLIGILDQKLRSRGMGGVVKVPTTVRASQFNHVTGEYQKKPLSQRWNEMPDGRRIQRDLYSAFLLQHVNEAQDGFDVAALIRDYENFVTLHDRMIETLKTAPKTLTSMGIWRTAS

SEQ ID NO: 2343 - protein, 495 aa, Unknown
  Description of Unknown: uncultivated organism sequence
  Category: MG81 effectors
  Description: MG81-623 effector
MPNTDSNRCILTLPLMTEPWQEHLIETRFDIMEHLKNSLIALELRKLKNLQRTRAYKELEKKIFEKPKEERKPLYKERSAMLRTAGFSEFDFINDMTPMQKHFADHIAAQISHRSASDVWRAFESYLFSSGREVHFQKRGTLDSVACKKAGNGMNYRNDTFEWSGGRTPNAKRLCIRVEKPQTEYEKHMLEKEVKNMRIIRKWMKTRYKYYLQLTLVGDPYQKPRKIGEGRVGIDIGTRTIAIASETTVRLLELADRIDGNHKRKCELQRKMDASKRATNPDNFNSDGTIRRRSKGKKMTWHFSKHYLRMRDQVRELERKNADIRTYQHNCLANEVLTLGTDVFVEPMSYKGLQHRAKETKVDEKGRYLKKKRFGKSLANKAPSKFLMILENKLACKGKALNYVDINRFRASQFDHTNGTYRKKQLSERFATLSTGEHVQRDMYSAFLLMNSNDSLNAPDIERCGQTFERFKELHAIEVERIRQSPYRRIQSFGI

SEQ ID NO: 2344 - protein, 522 aa, Unknown
  Description of Unknown: uncultivated organism sequence
  Category: MG81 effectors
  Description: MG81-624 effector
MKKSSTDTCCLTLPLKLEKWQSDRLEKRFEIGRQIYNTVVRAELKKLHQVERTPQYREIEQKLKEAKQEEAKELWKKRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSSNNDYETEMLSKRVKYVRILRKEGKTKPHWYAQLVLEGKPAIKRDPASGAPKHPVGHGVVGIDIGTRTLAYSADSKVDLIELADRVQNIELEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSVANKAPSMLIALLDQKCKSLNLEGVKKVDTAVKASQYNHQTDECKAKELKERWNIMPDGERIQRDLYSAFLLQHCKRGLPEYNRKKLQEAFGNELYRVFDREALQRDYPKFVEYHRETIQRLSALPKTIPSMGIRRIIS

SEQ ID NO: 2345 - protein, 496 aa, Unknown
  Description of Unknown: uncultivated organism sequence
  Category: MG81 effectors
  Description: MG81-625 effector
MAKNEQNCCVLTLPLLTEPWQEHIIETRFRIMEQLKNALIAKELGKLNNLKRTREWKRLMKSIQDAKDEKEKKQLFKKRTELLRNVGFSDFSFSNDVTNLKIHKHFAEHINSGIAQRAGKDVWRAFEKYLFSDGKTVHFHRRGTLDSVANRYAREGMMIDGDILTWKGGQSDHQIVLKIRIRRLKNAYEREMLQKTVRNLRIVRKWMKTRYKYYLQITLQGDPASKYRSVGKGRIGIDIGTQTIAWSSPTEVRLAELAAGIKRNHAEKTALQRKMDRSRRTANPQNYNPDGTIRRGVKLRWVKTKHYLRMEGRVRELERKNADIRKYEHICMANHILSLGNEVYIEDMSFKGLQGRAKETKLDKNGRFARKKRFGKSLANRAPSMFVTILENKLKASGGSLHKVNTRTFRASQYDHTADEFKKKTLGQRWNHLKNGDKIQRDLYSAFLLMNAAPSLEEPDKKLCGKTYPQFNRLHDAEMERLRAEEKPHLSSMGIH

SEQ ID NO: 2346 - protein, 540 aa, Unknown
  Description of Unknown: uncultivated organism sequence
  Category: MG81 effectors
  Description: MG81-626 effector
MATTDKKDEENLRAYKFRLDPNQAQTTALYQAVGAARYTYNMLTAYNLEVNRLRDDYWKRRHDEGISDADIKKELNALAKEDKRYKQLNYGAFGTQYLTPEKKRHEQAEHRIENGEDPSVVWNQETERSANPWLHTANQRVLVSGLQNASDAWDNFWASRTGKRAGRLVGTPRFKKKGISRDSFTVPAPEKMGAYGTAYLRGEPAYKQGRRKITDYRHVRLSYLGTIRTFNSTKPLVKAVAAGAKIRRYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLHQLTKKLATEYTLVGFEDLNVSGMTASAKGTVENPGKNVAQKSGLNRVVLDAAFGVFRNQLEYKAVWYGSAFEKVDRYFASSQTCSECGRKAKTKLTLRDRVFDCAYCGNMMDRDLNAAVNICREAQRLFDEKLASEDGESLNGRGSRGALRGAETVEASRPPASHRRGSP

SEQ ID NO: 2347 - protein, 509 aa, Unknown
  Description of Unknown: uncultivated organism sequence
  Category: MG81 effectors
  Description: MG81-627 effector
MARCTTPTCVLTLPLRLEKWQEDRLAKRFEIARKIYNTFLGVKLKELRRLEQTPEYRAIKKELAALYSEKEKNADRIRALYEERNALLKNFTEFKFKKDIKFYYKHFNSNIASKVATHCIASQVWSAFEKYLFGNGKRIHFKRPGEIYSLRGFSATNARSGGSEIIYRGDHIEWNKLRLPLKLDPGNQYEEEMLTNRVKYVRILRRPGKNRDHWYAQLTLEGLPSIKRDDETGDPVHPIGNGPVGIDIGPQTIAYSSAKEAGLLELADRVQNIEDKKCRIQRKMDRSRRATNPGNYNPDGTIKRGVPLTRNKSKRYLRLQKELAWIQHQQAAIRKEQHVALANYLLTLGDRFYIEDMNWQGLARRAKGTAVPEEEKPHKRKKRFGKSIANKAPAALVTILKNKCTSLGLPGVIPINTKVRASQYNHLTDSYQKKELSQRWNEMPDGRKIQRDLYSAFLLQHMNSQLDGFDRAALQRDYESFVSLHDQAILRAAAAPKLISSMGVKRTAN

SEQ ID NO: 2348 - protein, 530 aa, Unknown
  Description of Unknown: uncultivated organism sequence
  Category: MG81 effectors
  Description: MG81-628 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGREIIFRGPYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKCGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 2349 - protein, 1387 aa, Unknown
  Description of Unknown: uncultivated organism sequence
  Category: MG81 effectors
  Description: MG81-630 effector
MKLTKVEKARIAVSREKKDSGRIILYTNPEDVKKTSVTTMEQQVSKRIDQANKLYQVFFKSVIPVELNKHFAEISKIAAKCRNTEEFYKKACGYSGYEWTDAKQKKRTSQISRFSYTSSGKNMYVVMDNFVKEYMVQIWQEKDFRNAAVKILCCICDGKKFASKLEKVKKESPDTLKKFIEISGKCEGNPFVDYDTSFLEKVFTLVISQMVKNCDRKSYEQDDKEKIKKSIQKEIQWLSHVQSVTERSFGREGKTYLLFKIRNPYATEERLQTVLIRMRKTLKRGRNRDIAIVLLQGLAQMNQVTFTDTVKHLYQEEEKAFCDFIDAVNRDYYRVNIVKSVRNMDVKVQPDLNDNSILKLSGLGNIKKEALSDTLLRYAASADESDQVLLDIKKLLFEYFLPENSKETSKYTTVQNLWNIPYLPKIFFDYGFENEDSDDDNECAEDIETLCDVEPQYKINQHSLKRRIRYVNYGKYLQMTKNESDRERRYWIHYIKEFVEKNYVDSGRTLSEKNCYASSMMLNCWKEIIRYLCGKYIDIGKAVFHFTNLTAMPKPKDKIIYGQLEEQYKKGISSFDYEAIKAEETLQRDIVQSVVAAAFAFSKSVIDETKMEECQETNKEDILFLSENVLGSLLKENTIKLILRFYGGESSVAQKEYFDQQEIVQEMISHLKSIRNENFHYLDGAKKDNPHKYASILWKNDEMAYQKLTKQRYYANNVGLFYRAEEIQELVQELYSQKNITEAQIPAFRTVLKRKDLPGYMEELGILFPDNTQEKSKGDFEGTLYFLMKEIYYRDFIVKDKAAAYFFKAVDQNKEQSKKEDKHTERAAENFHRYVKSLEKKYNKKEISFGTVCQYIMMEYNQQNTTKQETEIYKHFKMLISLCIRKAFGNYIKETYRFLFHPIYSKQQGEPEYLDTLELESGVKEKNYEWFTLAHFLHPVQLNHLVGDLKSYIQYREDILRRIVFAEQRVYADQQKEVQQKVKTAKEILEVLEFVRKVSGRVSNEYTDYYENEEEYAEFLYQYIDFRKREGKSAFESLKYFCQNILDSGTVVDLYADTENPKVLRNIELTRMYAGSNVKIPEYEKITEDEIKMYYQEKNSVALILSRGLCRNEKEQKKVIEFNWKKKRLTLNEITDVFSLVNDLLGKMISFSYLRERDQMYLLLGFYYMALCAENKSENHLGWKGETLDKLESSDSKFDIGGGLVLYQIVSAFNFGSKLLYISEDGRWKMAGGAFPGKYGRFENDYNHRTSLSKVIRLFENESYEREIIYWRDYVDHMKYYVNQNQSIMEIYSAFYSKVLGYSAKLRKSVVFNLQAALEKHHINPECIWMTSDGKCADIKLMKNLESQKFTYKLAKREGEKTERKICMNALNENFLKTIRTSLEYKK

SEQ ID NO: 2350 - protein, 505 aa, Unknown
  Description of Unknown: uncultivated organism sequence
  Category: MG81 effectors
  Description: MG81-631 effector
MARAQTDTCCLTLPLKLEKWQSDRLDKRLEIARQIYNTLLRFELKKLLRLEESKEYTDIQNSLKEITDNTERNKLYKQIDKLRQKAGFSEYAFKTDIKEFYKHFSDNIGSSVAVHGIAAQVWTAFDRLFYGNGKAVYYKRRGELNSVRGYSVAGKSGGIEIIFRGNYIEWKGLKLPIKLDLTNTYENEMLQRRVKYCRLLKKPGRTKERWYVQLMLEGKPAIKVDKNTGELRHPVGRGAVGIDIGPQTIAYVSDSEIDLKELADQVNNIEREKRVLQRKLDRSRRATNPDNYAPDGTIKRGVKLSHNKSKRYIKTQRELAALQRQQADIRKRQHNELANHLLSLGDCFYIEKMEWPALTHRAKQTEISEKTGKDKRKKRFGKSVGNKAPATLTGLLDQKLKSRGLSGIIEVDTKVRASQYNHLTDDYHKKELSERWNFMPDGRRIQRDLYSAFLLQHMNEQQDGFDKTALQRDYERFVIQHDQCIEELKRAPKTLASMGIVRRAS

SEQ ID NO: 2351 - protein, 521 aa, Unknown
  Description of Unknown: uncultivated organism sequence
  Category: MG81 effectors
  Description: MG81-632 effector
MMATWKGGIPVGKSSTDTCCLTLPLKLEKWQEDRLAKRFEIARQIYNTMVRAELKKMDRVKQLPEYRKNQKEIQALDWKNSADKQRLKELYGNQNRILQKQGFTKYGFKSDSKDYYKHFIENIGSSVATHCIAPQVWNAFDKMLFQKDGKVVHFKRYGDVHSLKGGSVTNKSGGAEIMFRKTYIEWKGLKLPLKLSPNNAYEAEMLSYRVKYVRILRTRGKTKDRWYAQLSLEGKPAVKYDSSTGKPVHPVGRGAVGLDIGPQTLAYAAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKNTEVSEKTGRIKRKKRFGKSVANKAPASLIGILKLKCISLGLTGVVEVPMLLKASQYNHQSKDYAPKSLSQRWNDMPDGNRIQRDLYSAFLLQHYNSQLENFNQETLERDYPQFVRLHNQTIQRLSALPKTPSSMGIRRSVS

SEQ ID NO: 2352 - protein, 530 aa, Unknown
  Description of Unknown: uncultivated organism sequence
  Category: MG81 effectors
  Description: MG81-633 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISKNGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTCEKKSLSERWNYMPISDGSDSSKTKRIQRDLYSAFLLQHTIPQPCSFDKEALRIDYPNFVTMHDAEIHRLGSLPKTITSMGVRRSHS

SEQ ID NO: 2353 - protein, 511 aa, Unknown
  Description of Unknown: uncultivated organism sequence
  Category: MG81 effectors
  Description: MG81-634 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDSKAGNFDSALLQQDYPQFVQYHHRAIQRLSTVPKTLSSMGIQRSLR

SEQ ID NO: 2354 - protein, 511 aa, Unknown
  Description of Unknown: uncultivated organism sequence
  Category: MG81 effectors
  Description: MG81-635 effector
MKKSNTDTCCLTLPLKLEKWQEDRLSKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVGIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2355 - protein, 511 aa, Unknown
  Description of Unknown: uncultivated organism sequence
  Category: MG81 effectors
  Description: MG81-636 effector
MKKSNTDTCCLTLPLKLEKWQEDRLAKRFEIARQIYNTMVHAELKKLRNIEISQPYRQIQKQIEALNWKNQNDKARLKSLYNDRKKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2356 - protein, 509 aa, Unknown
  Description of Unknown: uncultivated organism sequence
  Category: MG81 effectors
  Description: MG81-637 effector
MRSTTETCCLTLPLVLEKWQSDRLEKRFEIARQIYNTLLNFELKKLRRLEQSEEYVAIQENIQTELQSEKPDQAARTALYRQRDKLRKDAGFTEYAFKTDIKDFYKHFKTNIASSVAVHGIAPQVWAAFDKLFYKNGKAVHFKKRGDLRSVQGYSTKKRSGGTEIIFRGTYVEWNKLKLPVKLDPGNAYETEMLQKFVKYCRILKKPGKKKPRWYVQLMLEGKPAVKREKFTEAIKHPVGSGPVGIDIGPQTIAYAAETETALEELAEGVQNIEREKRLLQRKLDRSRRSTNPDNFQADGTVKRGVKLQWNKSKRYQRIQHELAFLQHQQAELRKRQHIQLANHLLSLGDRFYVEDMDWPALTHRAKDTAISEKTGKFKRKKRFGKSVGNKAPATFLGILNQKLLSRGYPGIVKVPTSVKASQFNHITGDFQKKPLSQRWNDMPDGRRIQRDMYSAFLLQHMNEQNDGFDVDALHRDYQRFLAQHDAMIRELQKKKKTISSMGIARNAS

SEQ ID NO: 2357 - protein, 371 aa, Unknown
  Description of Unknown: uncultivated organism sequence
  Category: MG81 effectors
  Description: MG81-638 effector
MFREDRIIWNQQGNRDRKKVKREFLLKLSPDNPYEAEMLKRHVKFVRILRKDGKTKPHWYAQLVLEGKPAVKRDPISSAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2358 - protein, 503 aa, Unknown
  Description of Unknown: uncultivated organism sequence
  Category: MG81 effectors
  Description: MG81-639 effector
MLPDTAFKTGKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2359 - protein, 512 aa, Unknown
  Description of Unknown: uncultivated organism sequence
  Category: MG81 effectors
  Description: MG81-640 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMARKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2360 - protein, 162 aa, Unknown
  Description of Unknown: uncultivated organism sequence
  Category: MG81 effectors
  Description: MG81-641 effector
MGNQIYIEPMNYKGLQKRVKETQVDEKGRYKKKKRFGKSLANKAPSMFVTILKTTAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERRNISSYGIA

SEQ ID NO: 2361 - protein, 521 aa, Unknown
  Description of Unknown: uncultivated organism sequence
  Category: MG81 effectors
  Description: MG81-644 effector
MMATWKGGIPVGKSSTDTCCLTLPLKLEKWQEDRLAKRFEIARQIYNTMVRAELKKMDRVKQLPEYRKNQKEIQALDWKNSADKQRLKELYGNQNRILQKQGFTKYGFKSDSKDYYKHFIENIGSSVATHCIAPQVWNAFDKMLFQKDGKVVHFKRYGDVHSLKGGSVTNKSGGAEIMFRKTYIEWKGLKLPLKLSPNNAYEAEMLSYRVKYVRILRTRGKTKDRWYAQFSLEGKPAVKYDSSTGKPVHPVGRGAVGLDIGPQTLAYAAANEANLVELADQVQNIEQEKRRLQRKLDRSRRATNPDNYNENGTIRKGVKLTHNKSKRYCKLQKELSWIQHCQAETRKRQHIALANHLLSLGDCFYVEPMAWPSLTHRAKKTEVSEKTGRIKRKKRFGKSVANKAPASLIGILKLKCISLGLTGVVEVPMLLKASQYNHQSKDYAPKSLSQRWNDMPDGNRIQRDLYSAFLLQHYNSQLENFNQETLERDYPQFVRLHNQTIQRLSALPKTPSSMGIRRSVS

SEQ ID NO: 2362 - protein, 528 aa, Unknown
  Description of Unknown: uncultivated organism sequence
  Category: MG81 effectors
  Description: MG81-645 effector
MAKKNNNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 2363 - protein, 365 aa, Unknown
  Description of Unknown: uncultivated organism sequence
  Category: MG81 effectors
  Description: MG81-646 effector
MIEKTNLKTLKVRVKDKHQSILERMAFEVNQVWNAANEITATYSYIPVPEVGWLRNNFSAFDLQKDLKSIKAERGFILHSTTIQEVIAVHYKSRRQFKTDKLRWRVSGGTRRSLGWIPFKSGAAQWKNGQVYFAGHFFKVWDSYGLSQFEFRSGSFSQDSRGRWYFNIVVEAAQIASQATGQVGIDLGLKEVATCSNGLKLESKQFYRQLETKLGVAQRANKKQRVKAIHAKIKNRRLNHIHQFTTRLVKDNALIVVGNVNSSQLAKTKMAKSVLDAGWYILKTQLDYKSKAMQAVFIEVNESYTTQACSCCGSISANSPKGRAGLRIREWSCPECGALHDRDINAAKNILALGHERLAAGIRAL

SEQ ID NO: 2364 - protein, 354 aa, Unknown
  Description of Unknown: uncultivated organism sequence
  Category: MG81 effectors
  Description: MG81-647 effector
MVGHLCRPHRHAPAVERHRAGDLVRVRARLGGERRQERRYKKGIKTRDQSRGWHQAVLMVQRYHREIADARADALHQCSRRIVDMGAETIVMRDNDVAGMLARDAQNTDADRQRRNRIAPLVAQMGGMYELRRQVTYKQQWAGGRVELVPEHEPTTLRCSVCLAVRDTDPGYPEFSCPSCGHVEDREANSARNLLDYVPPPENGSDKNFTGTGNGDGGAGGRAVRQKRGRKPKRMAGGTGPLEAEQSAASPEGGATSVLGPGNHAPDAQAPGVTDAAAASVAAAIQVDGGMVPPPRKRHTTAHERERSSDADPATESSRALGGERATRKRDRSQSVPQRRGSPRDPQEPSGAAA

SEQ ID NO: 2365 - protein, 511 aa, Unknown
  Description of Unknown: uncultivated organism sequence
  Category: MG81 effectors
  Description: MG81-648 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLDRRVKYVRLLRKPGKRKDCWYVQLSLEGKPAIKRDPESGERRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRMKRKKRFGKSVANKAPATLIGILEQKCNSLGLPGVVKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 2366 - protein, 523 aa, Unknown
  Description of Unknown: uncultivated organism sequence
  Category: MG81 effectors
  Description: MG81-649 effector
MPTKQKEDSNRCVLTLPLLTEPWQEHIIEKRFKIIEHLKNQLISIELRKLKKLQRTKAYKNLIKQIESVPKSERTVLYKKRNKMLKDAGFSQYTFMDDMAGKKSLMQKHFESHINVQIAHKAAIDVWSSFEKFLFGTGQMIHYQKRGTLKSIASKSPKNGMHYFPESNTFKWSGGRQKKIGQKGEQKKVSIKPISLCLRVSPLKTDYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHSLNDRWRILGNGDKVQRDLYSAFLIKNSNKTHDEIDLDKCSKTYDIFKKLHDKEIENIRNEVKLRERKNISSYGIA

SEQ ID NO: 2367 - protein, 512 aa, Unknown
  Description of Unknown: uncultivated organism sequence
  Category: MG81 effectors
  Description: MG81-650 effector
MPTKQKEDSNRCVLTLPLLTEPWQEHIIEKRFKIIEHLKNQLISIELKKLKNLQRTKAYKNLIKQIESVPKSERTALYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIEIGTQTIAIASDKSVKLLELADEVNKNHIKKCELQRKLDRSRRYTNPDNFNPDGTVKRGTKGYKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2368 - protein, 512 aa, Unknown
  Description of Unknown: uncultivated organism sequence
  Category: MG81 effectors
  Description: MG81-651 effector
MKKSNTDTCCLTLPLKLGKWQEDRLAKRFEIARQLYNTLVHAELKRLAQVKQTAEYRENERKIRTLDWNDPGDQAKLKGLYKERRKSLKTAGFTDYSFTTDMGKYYKHFRDNIGSNVALHGIAPQVWAAFDKLLFKKGGKKVHYKKPGEVNSVQGYSRTGKSGGTEIMFREPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKRRLQRKMDRSRRAANPDNYAEDGTIRRGVKLTHNKSKRYRRSQQELKYLQHRQAEIRKLQHIQFANHLLSLGDHFYVEKMEWSSLTHRAKETVISEKTGKPRSKRRFGKSIANKAPAMLIEILRQKCKSLGLSDVVEINPADIKASQYNHLTGEYVKKSLSRRWNDMQDGEHLQRDLYSAFLLQHYDSCSKTLDHDSIVRDYPAFVQYHHREIERLHALPKTPSSMGIRRSIA

SEQ ID NO: 2369 - protein, 512 aa, Unknown
  Description of Unknown: uncultivated organism sequence
  Category: MG81 effectors
  Description: MG81-652 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGAVYEVDIMSYRASQCDHTTGEYTKHGLNDRWRILGNGDKVQRDLYSAFLIKNSNKTHDEIDLDKCSKTYDSFKKLHDKEIENIRNEVMLRGRKNISSYGIA

SEQ ID NO: 2370 - protein, 512 aa, Unknown
  Description of Unknown: uncultivated organism sequence
  Category: MG81 effectors
  Description: MG81-653 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSIASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNANIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2371 - protein, 512 aa, Unknown
  Description of Unknown: uncultivated organism sequence
  Category: MG81 effectors
  Description: MG81-654 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAEKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2372 - protein, 512 aa, Unknown
  Description of Unknown: uncultivated organism sequence
  Category: MG81 effectors
  Description: MG81-655 effector
MPTKQKEGGNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKAHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLEKCSKTYDNFKKLHDKEIENIRNEVILRKRRNISSYGIA

SEQ ID NO: 2373 - protein, 511 aa, Unknown
  Description of Unknown: uncultivated organism sequence
  Category: MG81 effectors
  Description: MG81-656 effector
MGKSSTDTCCLTLPLKLEKWQEDRLAKRFEIARQIYNTMVRAELKRLRQVEQSPQYRSNKKAIQALDWKNTADKPKLKTLYRERDKLLKGGGFTEYGFKSDIKNFYKHFAENIGSSVAVHGIAPQVWAAFERVLFKKEGKKVHFKKTGDIRSLRGYSVTGKSGGVEIIFRGSYIEWKGLNLPLKLSPDNAYETEMLSYRVKYVRILRKPGKTRDRWYAQLSLEGKPAIKRNPASGNPVHPVGQGAVGLDIGPQTLAYAAEKEANLVELADRVQNIEREKHLLQRKMDRSRRAANPDNYAENGTIRRGVKLTHNKSKRYLRLQRELCYLQHCQAETRKRQHTELANHLLSLGSCFYVEDMAWPSLTHRAKKTEISDKTGRIKRKKRFGKSIANKAPAALINILRTKCVSLGIPGVVEVPTSLKASQYNHQSKEYTPKPLSQRWNDMPDGSRIQRDLYSAFLLQHYDPQSGNFDQASLEADYPQFVQLHNQSIQRLLTVPKAPSSMGIRRSVS

SEQ ID NO: 2374 - protein, 512 aa, Unknown
  Description of Unknown: uncultivated organism sequence
  Category: MG81 effectors
  Description: MG81-657 effector
MPTKQKEDSNRCVLTLPLLTEPWQEHIIEKRFKIIEHLKNQLISIELRKLKNLQRTKAYKNLTKQIESVPKSERTALYKERNKMLKDAGFSQYTFMDDMAGKKSLMQKHFESHINVQIAHKVAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRVKETQVDEKGRYKKKKRFGKSLANKAPAMFVTILKTKAEQHGGEVYDVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2375 - protein, 341 aa, Unknown
  Description of Unknown: uncultivated organism sequence
  Category: MG81 effectors
  Description: MG81-658 effector
MVGRRNKTKGWYYSLLAVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVRRGTKGHKLKWNKSKHYIEIAGKIRELERKNSDIRKYQHTCLANDILAMGNQIYIEPMNYKGLQKRAKETQVDEKGRYKKKKRFGKSLANKAPSMFVTILKTKAEQHGGEVYEVDIMSYRASQCDHTTGEYTKHGLNDRWRILGNGDKVQRDLYSAFLIKNSNKTHDEIDLDKCSKTYDNFKKLHDTEIENIRNEVKLRERKNISSYGIA

SEQ ID NO: 2376 - protein, 360 aa, Unknown
  Description of Unknown: uncultivated organism sequence
  Category: MG81 effectors
  Description: MG81-659 effector
MFTYRYRIRDSSSKVRLKKLASSVNFVWNYVNKLSFENIKQHGRFLSTYDVNYYLNGCSKGLEIGSSSIQEIARFYVQTRQQFKKRKLSWRSAKRSLGWVPLRHDGFKLKNDTVRYCGHDFKLWKHRELPQGAKIKTGSFVQDARDRWYLNVSFEVPDVEVHALPRTEVGIDLGIKNQLTLSTGENFTRGSETKKFAVDLAHAQRARKKKRMKAVSAKAANRRSDWTHKVTTDIVRRFATVFVGDLKTSELVAKSSLSNFSSLYDASIGSIKHCLKYKAKKLGGACYVVNEAYTSVTCYFCEARSGPTGKGGLAIREWTCQSCGAVHHRDVNAARNILRRGHSTLQRSLIGGDATLSTSA

SEQ ID NO: 2377 - protein, 511 aa, Unknown
  Description of Unknown: uncultivated organism sequence
  Category: MG81 effectors
  Description: MG81-660 effector
MAKCSTDTCCLTLPLRLEKWQEDRLAKRFEIARQIYNTMVRAELKKLRAMEQSEPYKANQEKIQALDRKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2378 - protein, 512 aa, Unknown
  Description of Unknown: uncultivated organism sequence
  Category: MG81 effectors
  Description: MG81-661 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYAKHGLNDRWRILGNGDKVQRDLYSAFLIKNSNKTHDEIDLDKCSKTYDNFKKLHDKEIENIRNEVILRKRRNISSYGIA

SEQ ID NO: 2379 - protein, 578 aa, Unknown
  Description of Unknown: uncultivated organism sequence
  Category: MG81 effectors
  Description: MG81-662 effector
MAFGSKNSTPSFVLTLPMVIGLNEQDLLYKEFKKCGIIYNQLVSVTTKMWHQLRKTRKYRELMAAIAKATPDSDEQKALFKRREKMLKEYRFSEDAFHAMVVPYAKHYAINSHVAQSVATAVWAAWSSFFFDNGKEVHYKKLEQVSSIFGKNNATGIILRPANCTTSVINSAKKKIKNSIEEKYFAAYRKPDAKEDEEVALPDEVKTQMEKEIAAATAKVKTSIGKGELRIVYGDYTFPLTLRNPNTQTGWYQQEALKCGVKYCRIIRKWVGTKWKYYAQIVLEGYPPIKCDSNGVAKHSVKQGRVGIDIGTQTIAFSGKDVCDLRVLAPSARAQAKSLVNEIAATLRAMDRSRRATNPKYYNPDGTIKRLKRQHGQKQRREWKYSKRYYRLRAKLRNLYRKLADIRKMEHNILANELLAHGNEFVVEDMNYKALQKRSKETKINPKTGRTHTKKRFGKSLSRCAPATFISILSKKANRYGGTVIKVSTFETKASQFDHTDESYTKKKLSERMARLRSGDIVQRDLYSAFLLEHIDTESLQYNMETLNSAFPAFLEMHENTKQRLQAVGSSLPASIGF

SEQ ID NO: 2380 - protein, 578 aa, Unknown
  Description of Unknown: uncultivated organism sequence
  Category: MG81 effectors
  Description: MG81-663 effector
MAFGSKNSTPSFVLTLPLDINLNEQDYLYKEFKKCGIIYNQLVSVTIKMWHQLRKTRKYRELMAAIAKSASDSDEQKTLYKQREKILKEHHFSEDSFHKLVVPYAKHYAIHSHVAQAIATDVWKAWKSFFFSKGKEVHYKRLDDVSSISGKNNATGIVLRPAKLTTSNLASAKRKVQKTVEQRYYKAYGQSDPKDDKKVILPDSVIPQMEAEIAVAVAKVKPAVGNGSLRIVYGKHEFPVVVRNSNTQTGKYQQEALKCGVKFCRITRKWVKIKWKYYAQLVLEGYPPTKCDSNGVIKHPIKQGCVGLDIGTQTLAISGSDICDLRLLAPSARAQAKGLVNEIARTQRAMDRSRRATNPDCYNPDGTIKRLKCQHGHKQKRDWKYSKRYYRLRARLRDLNRRLADIRKMEHNILANELLEHGNEFIVEDMNYKALQKRSKETKVNAKTGRIHTKKRFGKSLSRCAPAMFITILTNKVTRYGGKVIKVSTFETKASQFDHTDESYTKKKLSERMAHLSSGEVVQRDLYSAFLLEHIDTESLEYNTEALKSAFPAFLKMHENTKKHLQKEENNLPASVGF

SEQ ID NO: 2381 - protein, 578 aa, Unknown
  Description of Unknown: uncultivated organism sequence
  Category: MG81 effectors
  Description: MG81-664 effector
MAFGSKNSMPSFVLTLPLDISLNEQDYLYKEFKKCGVIYNQLVSATTKMWHQLRKTRKYRELMAAIAKATPDSDEQKTLFKQREKMLKEYRFSEDAFHKLVVPYAKHYAINSHIAQAVASNVWKAWSTFFFSKGKEVHYKRLDDLAAISGKNNFTGFVLRPANLTTSNIESAKRKAQKAVEKRYDDMYGRPDPKDDKKVVLPDEVKPQMEAEIAAAIAKIKPTIGEGNLRIVYGKHEFPVVLRNPKTQTGKYQQEALKCGVKYCRITRKWVKNKWKYYAQFILEGYPPTKCDGNGVMKHPVNQGRIGLDIGTQTLAVSGNDICDLRVLAPSARAQARGLTNEIARTTRAMNRSRRATNPQYFNSDGTIKRLKRQHGHKQKRDWKYSKRYFRLKAKLRDLNRRLADIRKMEHNILANELLEHGNEFVIEDMNYKTLQKRSKETKINAKTGRTHTKKRFGKSLSRCAPAKFITILTNKAVRNGGSVIKVSTFETKASQFDHTDESYTKKKLSERMARLRSGDIVQRDLYSAFLLEYIDTESLEYNTKALNSAFPAFLVMHENTKKRLQKDKSYLPASVGF

SEQ ID NO: 2382 - protein, 578 aa, Unknown
  Description of Unknown: uncultivated organism sequence
  Category: MG81 effectors
  Description: MG81-665 effector
MAFGSKNSTPSFVLTLPLNISLNEQDYLYKEFKKCGVIYNQLVSVTTKMWHQLRKTRKYRDLMTAIAKAVPDSEEQKALLKQRQKKIQETGFSEGAFHKMVEPYAKHFAINSHVAQNVASAVWTAWEGFFFSKGKAVHYKKLEDVTSISGKNNATGIVLRPANLTTSNIESAKRKAQKAVEKRYDDMYGRPDPKDDKKVVLPDEVKPQMKAEIAAAIAKIKPTIGKGNLRIVYGKHEFPVVLRNPKTQTGKYQQEALKCGVKYCRITRKWVKTKWKYYAQFILEGYPPTKCDGNGVMKHPVNHGRIGLDIGTQTLAISGKDICDLRVLAPSARAQARGLTNEIARTTRAMNRSRRATNPKYYNSDGTIKRLKRKHGHKQRRDWKYSKRYFRLKAKLRDLNRRLADIRKMEHNILANELLQHGNEFVVEDMNYKALQKRSKETKVNPKTGRAHTKKRFGKSLSRCAPAMFISILNKKANRYGGSVIKVDTFETKASQFDHTDESYTKKRLSERMAHLSSGEVVQRDLYSAFLLEHIDIESLQYNMETLNSAFPAFLEMHENTKRRLQAVGSSLPASIGF

SEQ ID NO: 2383 - protein, 578 aa, Unknown
  Description of Unknown: uncultivated organism sequence
  Category: MG81 effectors
  Description: MG81-666 effector
MAFGSKNSTPSFVLTLPMVIGLNEQDLLYKEFKKCGIIYNQLVSVTTKMWHQLRKTRKYRELMAAIAKATPDSDEQKALFKRREKMLKEYRFSEDAFHAMVVPYAKHYAINSHIAQAVASDVWKAWSTFFFSKGKEVHYKRLDDLAAISGKNNSTGIVLRPANLTTNNIESAKRKAQKAVEERYDDMYGRSDPKDDKKVVLPDDVKPQMEAEIAAATAKVKTSIGKGELRIVYGDYTFPLTLRNPNTQTGWYQQEALKCGVKYCRIIRKWVGTKWKYYAQIVLEGYPPIKCDSNGVAKHSVKQGRVGIDIGTQTIAFSGKDVCDLRVLAPSARAQAKSLVNEIAATLRAMDRSRRATNPKYYNPDGTIKRLKRQHGQKQRREWKYSKRYYRLRAKLRNLYRKLADIRKMEHNILANELLAHGNEFVVEDMNYKALQKRSKETKINPKTGRAHTKKRFGKSLSRCAPATFISILSKKANRYGGTVIKVSTFETKASQFDHTDESYTKKKLSERMARLRSGDIVQRDLYSAFLLEHIDTESLQYNMETLNSAFPAFLEMHENTKQRLQAVGSSLPASIGF

SEQ ID NO: 2384 - protein, 578 aa, Unknown
  Description of Unknown: uncultivated organism sequence
  Category: MG81 effectors
  Description: MG81-667 effector
MAFGSKNSTPSFVLTLPMVISLNEQDLLYKEFKKCGIIYNQLVCITTKMWHQLRKTRKYRELMADIAKAAPDSDEQKALLKQREKMLKEYRFSENAFHAMVVPYAKHYALHSHVAQMVATAVWAAWSSFFFDNGKEVHYKKLEQVFSISGKNNTTGIMLRPANHTTSVINSAKKKIKGSIEEKYFAAYRKPDAKEGEEVVLPDEVKTQMEKEIAAATAKVKTSIGKGELRLVYGDYTFPLTLRNPDTQAGWYQQEALKCGVKYCRIIRKWVGTKWKYYAQIVLEGYPPIKCDSNGVAKHPVKQGRVGIDIGTQTIAFSCKDVCDLRVLAPSARAQAKSLVNEIAATLRAMNRSRRATNPKYYNPDGTIKRLKRQHGQKQKREWKYSKRYYRLRAKLRNLYRKLADIRKMEHNILANELLAHGNKFVVEDMNYKALQKRSKETKINPKTGRAHTKKRFGKSLSRCAPAMFISILSNKANRYGGSVIKVSTFETKASQFDHTDNSYTKKKLSERMARLRSGDIVQRDLYSAFLLEHIDIESLQYNMETLNSAFPAFLGMHENTKQRLQAVGSSLPASIGF

SEQ ID NO: 2385 - protein, 358 aa, Unknown
  Description of Unknown: uncultivated organism sequence
  Category: MG81 effectors
  Description: MG81-668 effector
MVKTFSFRIKDSTSAKHLYAMARAVNFVWNYCNEVQKKAANSHRPWVNWVMLNNLTSGCSKELRLHSQTIQAIDECYATSLKEAKSPTGKKKRFLRFRGRRSQGWIPFKASGIKLRKDSVVYQGRIFRFWKTRSIPEQIKGGNFSCDVRGRWYLNLVCEYEEALVSNEGSVGIDLGLKSLATLSNGKKYDAQKFFRKYERKLAHHQRCNNARQVRTIHAKIANSRKDFNHKVSHELTRDFNKVFIGDVDSLGLLKTRLAKSVSDASWGQLRTFIEYKAIARGGTYYVVDENNTTRTCSACGCLTGPSGLAGLRVREWQCKECGTVHDRDTNSAINIEQRGLSTLHSPLRTLSAKEEIP

SEQ ID NO: 2386 - protein, 512 aa, Unknown
  Description of Unknown: uncultivated organism sequence
  Category: MG81 effectors
  Description: MG81-669 effector
MPTKQKEDSNRCVLTLPLLTEPWQEHIIEKRFKIIEHLKNQLISIELRKLKKLQRTKAYKNLIKQIESVPKSERTVLYKKRNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVAPVKTNYEKEMVANNEIKYYRVVRKWMKTKYKYYLQITFAGKPADKHHEVSTDRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2387 - protein, 401 aa, Unknown
  Description of Unknown: uncultivated organism sequence
  Category: MG81 effectors
  Description: MG81-670 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRLKKRKLTKKADIKRKSVLENLLPIKRRQCLLQF

SEQ ID NO: 2388 - protein, 116 aa, Unknown
  Description of Unknown: uncultivated organism sequence
  Category: MG81 effectors
  Description: MG81-671 effector
MFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2389 - protein, 1268 aa, Unknown
  Description of Unknown: uncultivated organism sequence
  Category: MG81 effectors
  Description: MG81-672 effector
MKVSKVKHRRTAVSVNKKNNTVKGILYDDPIKKDSKGDGASAYVSTKYVVDDVVRNSSRLYSPFNSKKLIIDDKTKVVANSLRQHFKNFVKIYLNCESIDEQQMKFTPDNKYLMDNRVRISLPSDVNEEKLVEAIVNSSLRKSLNKKCNIQIKAGLRETFDIPELIKKAIKIYCIDEKRNLNDAEKLDMYALFSFMYEDKYKNRQKKLIINSISNQVTKVKVCENGNRLLKLSIADTKKKPLWDFMIEYSNSDKKKQDTMLRNIRKSIVLFVCGVENYKNIENDNKLDICSWDGYDINENQQFVCVNTNNSNDDYFISSTELRRANLDHYMKAVAKLNDDRNKFWFQHFESVIETFFSKKAKRNIERIKSAYLCEYLWRDFCSYVALKYVDLGKGVYHFTMADKLALINRNKYEKSIIFGEIESRYNNGISSFDYERIKAEELFERNISTYTTFATNIFSKAVVQDDYIKNHNKASDVLQYSDKEFSDSKVLRNDAMKRILQYWGGQSRWNNTLNKINVDTLCIDIKEHLSNIRNSSVHYTSKVSLSGDKNESIVYMLFKKDFAEIRNIFASKYYSNNVWMFYSIEKINGLMEYLYGDNSTVIDAQIPAYNNIIKRKNIADVIEKIIKKNSYKTINELELIKKYRACLYFILKEIYYNRFIKQENLKEQFIQFVDNDNNLLDDNKNAVESFRRRIHDIDNSLMSFGEMCQFIMTDYNMQNQGNKSIKSKDRQNEDKKKGIDGSYKHFPLLLYHVIKELFLKYIKTDEKIVFIREPANIGSVKTQDEFETHISTLGLYKTLKEKVDSNMSLLDWYTLSHFLMPKQLNYLIGDIKNYIQYLRNIDKRAESVGNNKAYDIDGKINNYYDIVYVLDFSLQYIGRISNEITDYFADEDEYALFMSQFVDFSSDNIVGLKTFCNEKTSNGKHTIGLYCDGANPIMNRNIAYAKMYSNDKILSRTYSKVTIKEIERYYRIQDDLKNVFENGVCKNKDQQKELCDFQKIKNHIELTEISIYTNILNDFMSQFISWSYLRERDLMYFQLGMHYLRLYYGTNELETKYNKLVGESVNIEKGALLYQIAAMYTYKLPIYKVDKNGSAVLAEKQGGTGASVTSFVTEYCKENMRDAIIYEKGLELFEDVKQHKKWSDFRNDIAHMRYISDRDKSIMDIISEIYGGFFTYDIKLKKSIPVIFKNILMRYAVDANLNFLHKENRKLKDTLINIRADKGLVSDKYTYKIGEKDTVDIEVRNDKFLLQLRKLLEYKIRVNGNVL

SEQ ID NO: 2390 - protein, 352 aa, Unknown
  Description of Unknown: uncultivated organism sequence
  Category: MG81 effectors
  Description: MG81-673 effector
MKHTKTLQVRVRDKHTQLLRQMARQVNFVWNYLNELSHRSIRERGVFLSAYDLDRYTQGASKELGLHSQTLQEVSREYATRRRQFKKARLSWRKSIGVRRSLGWIPFKSGAASWKNGQVFHNGRCFKVWDSYGLGQYRLRSGSFSEDARGRWYFNVVVELETQLSTGQGAVGIDLGLKDVATCSDGQRLENGRFYRDLEPKLASAQRAGKKARVRAIHAKIANRRKDALHKFSRSLVERCNTIIVGDVSPQKLVRTRMAKSVLDAGWGQLKTMLAYKCAHAGIVFRVVNEAYTTQTCSCCGALPASRPRGIAGLGIREWICECGVTHDRDVNAARNILALGHERPGEGIPGV

SEQ ID NO: 2391 - protein, 512 aa, Unknown
  Description of Unknown: uncultivated organism sequence
  Category: MG81 effectors
  Description: MG81-674 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRRYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDTEIENIRNEVKLRERKNISSYGIA

SEQ ID NO: 2392 - protein, 512 aa, Unknown
  Description of Unknown: uncultivated organism sequence
  Category: MG81 effectors
  Description: MG81-675 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2393 - protein, 352 aa, Unknown
  Description of Unknown: uncultivated organism sequence
  Category: MG81 effectors
  Description: MG81-676 effector
MKTLKLRIKDKNLKVLDQLASEVNFVWNYVNDLGFKYLKRTGEFLSSYDIDKYTKGASKECGLHSQTIQAISAELVTRRKQFKKAKLKWRVSNKKSARRSLGWIPFKKVAIKYADGYVQYGKHQFKLWDSYGLSKYNVKTGSFVEDSRGRWYVCLVVDNATTIKSKGKTSIGIDLGLKDLATCSDGLKLKAPKIYREYEQKLGIAQRAKNKNRVRSVHAKIKNIRQNMLHQFTRKLVNEHAMIIVGNVNAKALAQTKLAKSVLDASWTTLRTMLKYKCENARVLFEEVNEAYTTQTCSCCGSRLSSPKGRTGLRIREWQCMECGTLHDRDINSALNILALGHERLAVGIPVL

SEQ ID NO: 2394 - protein, 513 aa, Unknown
  Description of Unknown: uncultivated organism sequence
  Category: MG81 effectors
  Description: MG81-677 effector
MPYGQKSKTDTFILTLPLITNSHDEAVLYSNFEKYCKAYNWLVQKTTEMWHQVRKTRRYRELVSAIANTAPKSKERKALYKKRTELLESYGFTSVLFEKKLKAYAKYYHLHSAISQKIAARVWDAWYKFFYKNGKSVHYKKLDDFVSFAAKTNGTGIQFLDDNGLYIKFRGRCIPVKLRKGNTAWYQQEALKRKVKFCIIKREMIRGRWRYFVQLALDGYPPIKCDGNGVAKHPVEPGHIGIDIGTQTIAFSGKDVCDLRVLAPSAIAEARNGLTKEIARIMRQMDRSRRAMNPQYFNENGTVKRLKRKNGHKQIRHWNYSKNYYRLLHRLRDLNRKLAAVRKTEHYILANEMLTYGNEFYVEDMNYKALQKRSKKTKINPKTGRAYTKKRFGKSIGRCAPALFITILGQKASRYGGSVIKVSTFETKASQFDHTDDSYTKKKLSQRFAKLSNGTVVQRDMYSAFLLTHLDESLQGYDKEAIDKDFQQFMKLHNETKERLQNSHEWLPASVGF

SEQ ID NO: 2395 - protein, 386 aa, Unknown
  Description of Unknown: uncultivated organism sequence
  Category: MG81 effectors
  Description: MG81-678 effector
MAGDIPPNNDDQLNINTLYVHTTMNIQIKTLSVRIKDKHAAVLRQMAFEVNQIFNLANEITSAAYSNAGFFGAQKPQWLSAFDVQKPLLKERKERGYTIPSHTVQEIAAIHGKARKQFKRSRLRWRVSGGSRRSLGWVPFKIGSAVWKNGAVRFAGRIFNVWDSYGLGGFKFRAGSFSEDSRGRWYFNVCVEVETVPSTATSAVGIDLGLKDYATPSEGDPLIAGRFYRDLEPALGKAQRANKKARVRAIHAKIKNRRKDALHKYSTALVSSHAAIFVGDASSKKLVKTKMAKSILDAGWFMLKTQLEYKAIARSVVFEVVNESYSTQACSCCGAISSNSPKGRAGLRIREWTCCECGTTHDRDVNAAKNILAAGHRRLAVGIPFL

SEQ ID NO: 2396 - protein, 578 aa, Unknown
  Description of Unknown: uncultivated organism sequence
  Category: MG81 effectors
  Description: MG81-679 effector
MAFGRKESTPSFVLTLPLDINLNEQNYLYKEFKKCGTIYNQLVSATTKMWHQLHKTHEYRALMAAITKAAPDSKELKALLNQRQNMIHQFGFSEGAFHKMVAPYAKHFAINSHVAQKIASAVWTAWKNFFFSKGKVVHYKKLENVTSISGNNNATDIALRPANLTTSIIKSTKDKKKKAIEQRYYKAYGQPDPKDDKNVILPDAVIPQMEVDIVAAVAKVKLSIGEGSLRIVYSDHEFPVVVRNPNTQTGRYQQEALKCGVKYCRITRKWVRNKWKYYAQLVLEGYPPVKCDSNGVMRHPVNQGRVGLDIGTQALAISGSDICDLRVLAPSARAQAKSLVNEIACTMRAMDRSRRATNPKYYNPDGTIKRLKRKHGQKQKRDWKYSKHYYRLRAKLRDLNRRLADIRKMEHNALANELLQHGNEFIVEDMDYKALQKRSKKTKINAKTGRAHTKKRFGKSLSRCAPAKFITILTNKAVRNGGNVIKVDTFETKASQFDHTDESYTKKKLSERMAHLSSGEVVQRDLYSAFLLEHIDTETLKYDIEALKAAFPAFLKMHENTKERLQEAESYLPASVGF

SEQ ID NO: 2397 - protein, 578 aa, Unknown
  Description of Unknown: uncultivated organism sequence
  Category: MG81 effectors
  Description: MG81-680 effector
MAFGSKNSTPSFVLTLPLDISLNEQNYLYKEFKKCGVIYNQLVSATTKMWHQLRKTRKYRELMAAIAKAVPDSDEQKTLFKQREKMLKEYRFSENAFHKLVVPYAKHFAIHSHVAQKVASAVWTAWEGFFFSKGKAVHYKKLEDVTSISGKNNATGIVLRPANLTTSNIESAKRKAQKAVEKRYDDMYGRPDPKDDKKVVLPDEVKPQMEAEIAAAIAKIKPTIGEGNLRIVYGKHEFPVVLRNPKTQTGKYQQEALKCGVKYCRITRKWVKTKWKYYAQFILEGYPPTKCDSNGVMKHPVNQGRIGLDIGTQTLAISGKDICDLRVLAPSARAQARGLTNEIARTTRAMNRSRRATNPQYFNSDGTIKRLKRKHGHKQRRDWKYSKRYFRLKAKLRDLNRRLGDIRKMEHNILANELLEHGNEFVVEDMNYKALQKRSKETKVNPKTGRAHTKKRFGKSLSRCTPAMFISILNKKANRYGGSVIKVDTFETKASQFDHTDESYTKKRLSERMAHLSSGEVVQRDLYSAFLLEYIDTESLEYNTKALNSAFPAFLKMHENTKERLQEAGSYLPASVGF

SEQ ID NO: 2398 - protein, 536 aa, Unknown
  Description of Unknown: uncultivated organism sequence
  Category: MG81 effectors
  Description: MG81-681 effector
MDADEYKKLLKKFHKLSDRHILVAEADMSYPDVQKVVNLSDRIRKAGNELVSLMKKNYEQLMRTKKYRKLLQLYGSTEDKKKRKTYAGQLNEMQEQYNLTKESCRTLMIPIGKKYGIDAIFALTKAEDVWHGVEKCLYGNGKTLHFSKYGDLPCIRAKQINRGIPMSVKNDELKFKLGKLVFGIQVKDRFQTDEVNAVLDYLASPETTDRKAVQTLLEEACCISTYRPCYATLVPKFIRGKYRVYLHLTIEGRAKPKYDRFGNPRHKYGNGIVGADIGTQTVAYTSDTETGLKNLSERGNSIQTSERLERLYYRAMNRSRRATNPENYNADGTIKKGKKKWTYSRHYKKLKAKHAELCRINATNRQLAINEDVNHLRCLGDTFVTEPKNAARLMKRAKETTVNNKGKINRKKRFGKSVKNRCPGGFQAAVENKFKTSGGTYIEVPNNYRASQYDHTADDYIKKKLSDRMYKLADGTLVQRDWYSSFLLYCYNYRTNGIDKKKCAAEFKKCYSMEKDFIEWIKTNKIKVLNSGIKIA

SEQ ID NO: 2399 - protein, 349 aa, Unknown
  Description of Unknown: uncultivated organism sequence
  Category: MG81 effectors
  Description: MG81-682 effector
MLLTYRYRLKDGSRARKRELRRMARAVNRVWNYCNEAQLHALKHNKRWPRAFDLNNLVAGSSKLLGLQSHTIQAVCEKYAASREAKRKAKLRWRGKRSLGWVPFKASGIKQDGAGWVYLKRRFPCWLHRALPDGGAIKYGSFSEDACGNWFINIVVELPDVEQSDDGADIGIDLGLKDLAALSTGEKIENPRHLSKLAAKLARAQRANKKKLAARTHRKIARARADHLHKASRRITDAARVIVVGDVSSTKLVKTDFARSVLDAGWSSFKEMLRYKATARGASFVCAAEHGTSRTCSCCGDTASGPKGIAGIAVREWTCSNCGASHDRDVNAARNILRVGLNTLKGAPL

SEQ ID NO: 2400 - protein, 562 aa, Unknown
  Description of Unknown: uncultivated organism sequence
  Category: MG81 effectors
  Description: MG81-683 effector
MSRWNKDIEVGERCVLTLPLNCHPRDTRFLDQVFQIENKLKNQLIEWYKTQLNEMTRTRLWREASQALADLHTEYGPDMKLLAELDEKAKKKPLSKTKEAKRVQLRQKAKEFQAKQKPLYETRNGMIRKYEFSRGDFEKRMAKYRRSYTDFVGSMVAQRLADDVWDMFQSYLYGKGKAIRFSGINKFLTIEGKNNSANIVFDRKAMKVFIGQGRHKTGIRVKRSRKDPCGYEAEALSREICYCRITRKAYPEGWRYFLQLVLKGAPPVKAKPDTGELLHPMGEGRVGMDIGPQTLAYCGEDVLDLVELAPGAQNLQEEIRRINRAMDRSRRATNPGMFDKAGQIIPGNRLPRELLDSHGKRKWVKSKQYREMERHRRYLYRKQADLRKAKHQQLANKLLAAGDRFYVEDMSWRALSRRSKQARKNKKGKNLSKKRFGKSIANKSPGAFLSILEKKVLAQGGSFYRINIWKARASQFHHMTGQYIKKKLSQRVDILEDGSKVQRDLYSAFLIMHSNKALDGFLVSSCNRDYPKFLQMHNKAMAALAASDKPLPSSMGVRRKAA

SEQ ID NO: 2401 - protein, 512 aa, Unknown
  Description of Unknown: uncultivated organism sequence
  Category: MG81 effectors
  Description: MG81-684 effector
MPTKQKEDSNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLTQKHFESHINVQIAHKAAIDVWSSFEKFLFGSGQMIHYQKRGTLSSIASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGKKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEAKLRERKNISSYGIA

SEQ ID NO: 2402 - protein, 537 aa, Unknown
  Description of Unknown: uncultivated organism sequence
  Category: MG81 effectors
  Description: MG81-685 effector
MISNEEYKKLLKQFHKLSDRHILVVETDMSSSGIQKVIKLSDKIRKAGNELVSLMKKNYDQLMRTKKYRKLLKLYGSTEDKKKRKDLAEQLNKMQKQYNVTWDYCRTAMIPIGKKYGIDAVFALTKAEDIWRGIEKCLYDNGNTIHFSKYGDLPCIRAKQINRGIPMSVKDNKLQFKLGKSAFGIKINDVFQTDEVNAILNYLAEPEIVDNKAIQTLLDEAYCIDTYRPCYATLVPKLIRGKYRVYLHLTIEGKAKPKYDRFGNPRHRFGRGIIGADIGTQTVAYTSDTEIGLKNLAERGNSIQKSERLERLYYRAMDRSRRATNPQNYNKDGTVKKGRKSWKYSNHYKKLKAKHSELCRINAINRQLAINEDANHLRSLGDVFITESKNASKLMKRAKETTVNSKGKFNKKKRFGKSIKNRCPSGFQTTVEKKFKVSGGTYIEVPNNYRASQYDHTIDDYIKKKLSDRMYNLADGTLVQRDWYSSFLLYCYNYKTETIDKDKCFLKFEDCYNKEKALIEWIKANKIKILNSGIKVA

SEQ ID NO: 2403 - protein, 512 aa, Unknown
  Description of Unknown: uncultivated organism sequence
  Category: MG81 effectors
  Description: MG81-686 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSIASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGYKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2404 - protein, 347 aa, Unknown
  Description of Unknown: uncultivated organism sequence
  Category: MG81 effectors
  Description: MG81-687 effector
MIQYQLKLRMCKSQEQKCEQFLYHLSSVWNWAVRKIELNAKDHIYFSKMEFQNFLSNHSEKMGIPSHTLQGVICTAHDAWKRCFKKIGGKPKLKGMRNKMSSIPFPDPIKAPKGNRINLPALGSVRFHKMELPDGKIKCGRIVKRTSGWYLCLFIDAQPKVIERTGYGVIGVDGGFKDLLTLSTGEKISHPRELEVAAERLAQAQRGHDTKLAARIQEKIANRRKDRNHKLSRRLIAENVVIKFSADNHKAVARRFGKSVASSGHSQLQRMLAYKSPQSGTQYFEIAPKDSTKTCWVCGEPTGPTGLAGLSVRQWRCTTCGTFHDRDQNAAVNTLIAAAGCAVEVCI

SEQ ID NO: 2405 - protein, 369 aa, Unknown
  Description of Unknown: uncultivated organism sequence
  Category: MG81 effectors
  Description: MG81-688 effector
MTEDIVDQEGESGVRQCGARSALTVMRFRLRDKHARELSSQGRAVNFVWNYCNETQQKTARAGRKWLTAVDLQRLTAGASKDLDLHAHTIQKVCQQYDRSRKQHRKPWLRFRGRKSLGWVPFNQGHVTVVAPGKLKFRGVIYETMHWRDLPDGAVIRAGSFNQDSRGRWYINLPIEMPAEAFAKSGGSIVGIDLGLKDLATLSTGEKIENPRHLAKHAERHAKAQRAGKTKLARSIAAKVANCRKDYLHKASARIALAHGTIFVGNVSSERLARTRMAKSVLDAGWSTLRTQLSYKALRHGGKMIEVDERNTSRSCSVCGADSGPKGIAEIGIRRWECEVCGESHDRDVNAALNIVRVGLDTLVEGASL

SEQ ID NO: 2406 - protein, 362 aa, Unknown
  Description of Unknown: uncultivated organism sequence
  Category: MG81 effectors
  Description: MG81-689 effector
MINYQLKLKLTKYQEQQLESWLPILTSIWNWTIRKIELDAKDNIYYNSKFDFVNLLVNHSEKLGVSSHTMMCTTMTAYNLYQQYIKKKCGKPKFKGQRNKLNSILFPDIIKQPQNNKIQLRVIGKIKYHKQQIPEGNIKCVRIIKKVSGWYAVLTIDTKPKKISIISNNKVGIDPGFKHLLTLSNGDKIEHPREFEINAERLAQAQRGHNKKLAAIINEKIANQRKNRNHKLSRKLVSENELIVFSKDNHKNVAKKFGKSVSSSGHYQLQKMLEYKCRTDGRQYIEVDCKFSTMTCSTCNARTGPTGWEGLKVRNWECTECGTLHDRDINAAINTLNSGLGISHENTVKTEIQKTSNEWGNI

SEQ ID NO: 2407 - protein, 537 aa, Unknown
  Description of Unknown: uncultivated organism sequence
  Category: MG81 effectors
  Description: MG81-690 effector
MISDEEYKKLLKQFHKLSDRHILVVETDMPYSDVLKVMILSDKIRKAGNELVSFMRKNYDQLIRTKKYRKLLKLYGSTKDKKKRKDLADQLNEMQKAYNVTWDHCRRSMIPIGRKYGIDAVFALTKAEDVWRGIEKCLYGNGKAIHFSKYGELPCIRAKQINRGIPISVKDDRLQFKLGKTAFGIQVNDRFQQDEADAVLTYLAEPEIVDNKAVNTLIEDAYYIDTYRPCYATLVIKMIRGKYRVYVHLTIEGKTKLKYDKHGNPRHKYGKGVIGADIGTQTVAYTSDTEVGLKNLSERGNSIQTSERKERLLYRAMDRSRRAANPQNYNEDGTVKKGRKTWKYSNHYKKLKAKHSELCRINAVNRQLAINEDANHLRSLGDTFVTEPKNASKLMKRAKETAVNDKGRFNKKKRFGKSIKNRCPSGFQTTVEKKFKTTGGTYIEVPNNYRASQYDHTVDDYIKKKLSDRLYKLQDGTEVQRDWYSSFLLYCYDYKIQKIDKNKCITQFDNCYKKEKALITWIKAHKIKVLNSGIKIA

SEQ ID NO: 2408 - protein, 578 aa, Unknown
  Description of Unknown: uncultivated organism sequence
  Category: MG81 effectors
  Description: MG81-691 effector
MAFGSKNSTPSFVLTLPMVIGFNEQDYLNKEFKKCGVIYNQLVNATTKMWHQLRKTRKYRELMAAIAKAAPDSDEQKALFKQREKMLKEYRFSEDAFHAMVVPYAKHYAINSHVAQSIATAVWTAWSSFFFDKGKEVHYKKLEYVSSISGKNNATGIMLRPANHTTNVINSAKTKAKNSIEKKYFAAYRKPDAKEGEEVVLPDEVKAQMEKEIAAATAKVKTSIGKGKLHITYGDYTFPVTLRNPDTQTGWYQQEALKCGVKYCRIIRKWVSTKWKYYAQIVLEGYPPIKCDNNGVAKHPVKQGRVGIDIGTQTIAFSGKDVCDLRVLAPAARAQAKSLVNEIASTLRAMDRSRRATNPKYYNPDGTIKRLKRQHGQKQKRKWKYSKRYYRLRAKLRNLYRKLADIRKMEHNILANELLTHGNEFVIEDMNYKALQKRSKETKINSKTGRAHTKKRFGKSLSRCAPAMFISILGKKANRYGGSVIKVSTFETKASQFDHTDESYTKKKLSERMARLRNGDIVQRDLYSAFLLEHIDTESLQYNMETLNSAFPAFLEMHENTKRRLQAVGSSLPASIGF

SEQ ID NO: 2409 - protein, 353 aa, Unknown
  Description of Unknown: uncultivated organism sequence
  Category: MG81 effectors
  Description: MG81-692 effector
MKTLKLRIKDKHCKVLDQLASEVNFVWNYVNDLGFRHLKRKGEFLSAFDIAKYTKGTSKECNLHSQTIQAVTEELVTRRKQFKKAKLKWRVSNKKSARRSLGWIPFKKVAMKYANGYVQYGKHQFKLWDSYGLSKYTLKTGSFVEDSRGRWYVCLVVESPKQDKSTATKAIGIDLGLKDIATCSDGTVISNPKFYRKYEQKLGIAQRARNKKRVRALHAKIANSRKDHLHKASTKLVNENALIIVGDLSAKKLVKTKMAKSVLDTGFSALKTMLKYKCENAGVLFEEVQEAYTTQICSCCGEITSSSPKGRTDLGIREWECMSCGTAHDRDINSALNILALGHKRLAVGITLF

SEQ ID NO: 2410 - protein, 913 aa, Unknown
  Description of Unknown: uncultivated organism sequence
  Category: MG81 effectors
  Description: MG81-693 effector
MSYLAAKYIDLGKGVYHFTMKDKLDMLNKNEAVTDLRFGIVSEKYEKGITSFDYERIKAEEELDRNIAAYVTFAADIFAKSVIKSDYRTKKDNNSDVLQYSDKEFRNSEVIRDNAEKNILQYWGGYSRWGTENSKLPENNKVSDFGKLDVSDLCIDIKKHLAGIRNSSVHYTTKIKNESAADGSNVKILFEKDLADINIIYADKYYSNNVWMFYSLEDINKLIAFLYKEKRVIRQVQIPSFSRILKRKAMQDVINEIFKDDFDENIVNPELKEKYRNSLYFMLKEIYYNAFIIQPELKEKFKDKIKTMKSELYNKLKTIDKKEYKALYCMLSNEESALKNFADRIYSVDGDNVSFADICKILMTDYNMQNQEKKNIESMEQKKKNKGKDENYKHFPLLLHKVLKELFIEYLKQTHELEFLRNNICIKSDVTMESFESQIKGVEIYKDLKEKIDKNNSLLDWYVIAHFLMPKQLNHLIGNIKNYIQFATNIDKRAESVKNLTESGMVKRIQYYDDIVRTLEFSAQYIGKISNNINDYFNSEDEYVSFLSKYVGFINDKSEDVLTELKDFCREKINNGSQIIGIYYGGDNVIINRNVIYAQMYSNAEVFSNIYKKVTKNDIINYYEKQNDLKDVFKSGVCQNEDEQRSLCEFQQLKNRIELTELSTYADMVNDFMAQFVEWAYLRERDLMYCQLGIHYIRLFYSDNVLDEKYHKLSDNVIDIEEGALLYQIVAMYDYELRIFETDNSGNAKRIGQGGPGKSIPVFLKKYCNVTDVYECGLELFEDINQHEHIIRFRNDIAHMRYMSNQAMNIMSIVSNIYKSFFVYDTKLKKSISLVFKNILMRYGVIADLVFSYNNKNQSIKDDMDINIINIKNLKSDKYVYKIVNEDIVKQVEIEIRNQVFLEQLHNLLYFSR

SEQ ID NO: 2411 - protein, 392 aa, Unknown
  Description of Unknown: uncultivated organism sequence
  Category: MG81 effectors
  Description: MG81-694 effector
MSSEPPPEVDGANCIRTLRLKLKPEAYAWLNAAAVEINRVWNFANETSAKAARPFAGPPKWLSAYDLDKLTAGATEYFERIGSASIQRVNAEFATRRKQVKKTKLRWRSSRGSRRALGWLPFKAVQLKRKGKSLRFSGKAFRVFEQQRLLGVSWKSGCFTQDAVGDWWLNLAVEVRLEPPVAQNEEVGLDLGLKDTVATSDGEKLEAGHFYRNIEQQIAQAQRRGHKRQAKRLHRRAARRRKDALHKFSRMIVNRYQRIIVGDVSSARLVKTRMAKSVLDAGWGMLKAQLQYKSQQASRSVFIVSERNTTRACSNCRALTGPTGLDMLAVRTWVCSGCGGTHDRDVNAAKNIRFAVRCSPSLSGNESSPSHAPPSQAPCLREARNSALTAVA

SEQ ID NO: 2412 - protein, 556 aa, Unknown
  Description of Unknown: uncultivated organism sequence
  Category: MG81 effectors
  Description: MG81-695 effector
MAFGSKNSTPSFVLTLPMVIGLNEQDYLNKEFKKCGIIYNQLVNATTKMWHQLRKALFKQREKMLKEYRFSEDAFHAMVVPYAKHYAINSHVAQSIATAVWTAWSSFFFDKGKGVHYKKLEYVSSISGKNNATGIMLRPANHTTSVINSAKTKAKNSIEKKYFAAYRKPDAKEGEEVVLPDEVKAQMEKEIAAATAKVKTSIGKGKLHITYGDYTFPVTLRNPDTQTGWYQQEALKCGVKYCRIIRKWVSTKWKYYAQIVLEGYPPIKCDNNGVAKHPVKQGRVGIDIGTQTIAFSGKDVCELRVLAPSARAQAKNLVNEIASTHRAMDRSRRATNPKYYNPDGTIKRLKRQHGQKQKRKWKYSKRYYRLRAKLRNLYRKLADIRKMEHNILANELLVHGNEFIVEDMNYKALQKRSKETKINPKTGRAHTKKRFGKSLSRCAPAMFISILGKKANRYGGSVIKVSTFETKASQFDHTDESYTKKKLSERMARLRSGDIVQRDLYSAFLLEHIDTESLQYNMETLNSAFPAFLEMHENTKRRLQAVGSSLPASIGF

SEQ ID NO: 2413 - protein, 512 aa, Unknown
  Description of Unknown: uncultivated organism sequence
  Category: MG81 effectors
  Description: MG81-696 effector
MPTKQKEGGNRCVLTLPLLTEPWQEHIIEKRFKIIEHLKNQLISIELRKLKNLQRTKAYKNLIKQIESVPKSERTALYKEKNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2414 - protein, 512 aa, Unknown
  Description of Unknown: uncultivated organism sequence
  Category: MG81 effectors
  Description: MG81-697 effector
MKKSSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKVLFKKGGKKVHYKKPGEVNSVQGYSRTGKSGGTEIMFRGPYIEWKGLKLPLKVSPDNAYETDMLQRRVKLVRLVRRPGKRRDRWYAQLVLEGKPAIKADPVTGKAVRPIGSGPVGLDIGPQTLAYSAAGVAGLVELADRVQNIEQEKRCLQRKMDRSRRAANPDNYAEDGTIRRGVKLTHNKSKRYRRSQQELKYLQHRQAEMRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPSSMGIRRSIA

SEQ ID NO: 2415 - protein, 512 aa, Unknown
  Description of Unknown: uncultivated organism sequence
  Category: MG81 effectors
  Description: MG81-698 effector
MKKCTTDTCCLTLPLKLEKWQEDRLAKRFEIARQIYNTLVRAEFKKLNELERTPEYKKILEQIHSLDWKDSGNRQRLNDLYRERNQILKNAKFTEYGFKSDMKFYYKHFSDNIGSCVAVHGIAPQVWAAFERYLFKPEGKKVHFKRFGDVHSLRGYSKAGESGGAEITFCGTHIRWKNLELPIKLSPDNAYETEMLSRRVKYVRILRKPGKSKDRWYVQLSLEGKPAIKYDRNAGEIKHPVAHGAVGLDIGPQTLAYSAETTADLVELADQVQNIEQEKRRLQRKMDRSRRSTNPGNYNTDGTIRRGVKLTRNKSKAYCKLQRQLAYLQHTQAETRKRQHTELANYLLSLGDCFYVEEMKWSSLAHRAKETAVSEKTGRFKQKKRFGKSIANKAPSTLIGILQQKCESLGLPGIIYVPLSAKASQYNHLTGEYTPKPLSQRWNTMPDAQRVQRDLYSAFLLQHFDSQAGIYNLQSLQRDYPQFLQYHDQSIRRLSEMPKTLSSMGIRKSIRA

SEQ ID NO: 2416 - protein, 357 aa, Unknown
  Description of Unknown: uncultivated organism sequence
  Category: MG81 effectors
  Description: MG81-699 effector
MIKTLRVRVKDKHAALLRCMAYEVNQIFNKANAITAERACVCSDFGPCKPSYPTAFDLDKSVKKEPDYHIGSATVQEILAYHAKARKQFKRSKLRWRCSSGPRRSLGWIPFRVGQSKYKAGQIVFARHHFKIWDSYGLSGVEFKSGSFSEDARGRWYFNAAVEVAVEPFNGGGDIGIDLGLKDVATCSDGTKLPAERFYRGMENKLKIAQRTNKKARVRAIHAKIKNRRKDMLHKFTTELVKKNAAIFVGDVSSTKLAKTKMAKSIYDASWGLLKTMLSYKAIGYSAWFEDINESYSTQLCSACGEIPASSPKGRAGLGIREWTCSCCGAVHDRDVNAALNILAAGRCRLAGGIPAL

SEQ ID NO: 2417 - protein, 358 aa, Unknown
  Description of Unknown: uncultivated organism sequence
  Category: MG81 effectors
  Description: MG81-700 effector
MQTVTYKYRVKDRSARKTLARHAKACNQVWNYCNAFQRDIEARYRAGAPKRRWPSAFDLAKLCKGVGKELGIHQQTVGTVCDQFAKSRDKAKHSLRFRPSFGVKRALGWIPFQKQSRQIEGNSIWYLGKRYRFFSCKRRPLPDSAKGGAFVEDALGRWYVCFHVEVTERHPHGNGAIGIDLGLKSLAVMSDGQKIEAPRHYRQLEGKLAIAQRAHNKQRVRRIHAKIKNTRKDFLHKLSTTLADQNAIIAVGDVNSKQLAKTRMAKSVFDAGWSTFRTMLKYKSAGYVEVDEKFTTQTCSHCGALPPERPKGIAGLGIRAWECSSCGESHDRDVNAAKNILVLALSAERPVVESRIAA

SEQ ID NO: 2418 - protein, 550 aa, Unknown
  Description of Unknown: uncultivated organism sequence
  Category: MG81 effectors
  Description: MG81-701 effector
MGWKSKGRGGTLVDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSMQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRSIS

SEQ ID NO: 2419 - protein, 534 aa, Unknown
  Description of Unknown: uncultivated organism sequence
  Category: MG81 effectors
  Description: MG81-702 effector
MGWKSKGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQTGKSGGIEIIFRGSYVEWKGLKLPLKLSPDNDYETEMLSKRVKYVRILRQDGKTKPHWYAQLVLEGKPAVKRDPISGAPKHPIGRGVVGIDIGTRTLAYSADSKVDLIELADRVQNIEQEKLLLQRKLDRSRRATNPENYKPDGTIKKGVKLTRNKSKRYRRIQHQLAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2420 - protein, 391 aa, Unknown
  Description of Unknown: uncultivated organism sequence
  Category: MG81 effectors
  Description: MG81-703 effector
MQPKDLTHSHVHSVTRTLRLKVKTESYAWLNTAACEVNQVWNWSAEVSEKAARPCTGERKWLTGFDLNNLSAGASEHFDKVGADTIQRVNGEYAEKRRIAKRYRLKWRTSRGPRRSLGWVPFKAANLKRKGRAVRFCGKTLRVFEPERLEGVQWKQGHFAQDAVGDWWLSLPIAVQVDDSVAPLEKVGIDLGLKEIAVTSDDARCEKGRFYRDIERKIAQAQRRGHRRQAKYLHRRAANRRKDALHKFSRQIVDQYQKIVVGDVSSTKLVKTRMAKSVLDAGWGMLRRYLQYKSQQAGRTFQIVNERNSSRTCSNCDALTGPQGVNGLRVRRWRCAACGASHDREVNAARNHLRRAELPASVRERASVFAGPPSRASRSRKAGLEPVRTVA

SEQ ID NO: 2421 - protein, 522 aa, Unknown
  Description of Unknown: uncultivated organism sequence
  Category: MG81 effectors
  Description: MG81-704 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASNVAVHGIASQAWTAFEKVLFSKDGKMVHFKKKGELSSLRGYSRAGKSGGVEIIFRGSYVEWKGLKLPLKLSPDNDYETEMLSKRVKYVRILRKDGKTKTHWYAQLALEGKPAVKRNSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTRRYKRKKRFGKSIANKAPAMLITMLKQKCQSRGLEGVKEVDTHVCASQYNHQTDTCIKKALENRWNVMPDGERIQRDLYSAFLLQHCRRDLPEYNRKELQKEFGEELYRVFDREALQRDYPRFVAYHHMTIQRLSELPHTIPSMGIRRIIS

SEQ ID NO: 2422 - protein, 511 aa, Unknown
  Description of Unknown: uncultivated organism sequence
  Category: MG81 effectors
  Description: MG81-705 effector
MAKCSTDTCCLTLPLRLEKWQEDRLAKRFEIARQINNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2423 - protein, 343 aa, Unknown
  Description of Unknown: uncultivated organism sequence
  Category: MG81 effectors
  Description: MG81-706 effector
MPPSLMRTLRLKVRSEAYPWLNAAAIEVNAVFNYCNETSLKAATRTDLKRKWLTGFDLCALTAGATEYFDKIGADTIQSVCIHYAQKRKAAKKLKLKWRVSRGAQRSLGWIPFKAASLKRKGRGVRFAGKCIRVFERERLEGVKWQGGEFAQDAVGDWWLCLPVKVQADCSIAPQEEVGIDLGLKTIAVTSDGDRLEAGRWTHRYAEKLASAQRRGHKRQAKRIHRKIARCRADALHYFSRKMVDRYQKIVVGDVSSLKLVKTRMAKSVLDSGWGTLKRFLEYKCEHAARSFEVRDERYSTVTCSNCGALSGPREVNGLIVDHGNVATVESCMTETLIRLGIT

SEQ ID NO: 2424 - protein, 350 aa, Unknown
  Description of Unknown: uncultivated organism sequence
  Category: MG81 effectors
  Description: MG81-707 effector
MQTITIKLRLRDKHSAELRRQARAVNFVWNYCNETQQKAARDRRKLLTGFDLAKLTSGTSKMLDLHAHTISRVAIQYEKSRKQHRKLWLKWRGRKSLGWVPFNTGHVSFDGACLKFRGKVYEPMHLRDVLMPGVKIGAGSFNQDSRGRWYINLPVQAVTADSAPVARIGIDLGLKSLATMSDGSKIEAPRFYKTSETALATAQKRRKSKRTKAIHAKIANRRKDFLHKESARLAKTYGLIVVGDVSPNAIAKSRMAKSSLDAGWAAFKGMLSYKAIRHGGSTLEVSERYTTQTCSCCGSVGSSTRPKGIAGLGIREWSCEDCGTTHDRDVNAARNILRRGLATLAEGTPA

SEQ ID NO: 2425 - protein, 538 aa, Unknown
  Description of Unknown: uncultivated organism sequence
  Category: MG81 effectors
  Description: MG81-708 effector
MNNEEKEKDGATCCLTLPLKLEKWQSDHLEKRFEIARQLYNTLVHAELKKKCQVERMPEYQEIMKMIDAASNQKEKWALEKKRKAFLEENGFNRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2426 - protein, 356 aa, Unknown
  Description of Unknown: uncultivated organism sequence
  Category: MG81 effectors
  Description: MG81-709 effector
MKTLHIRIKDKHAKALDALARDVNMVWNYCNDLSYKHLQRTGKFFSSYDLQKYTAGATKEGLSINSASVQMIGAELVTRRKQFKKAKLRWRTSFGSRKSLGWIPFRHDCIAYKNGQLRYAGQCFGLWDSYGLSQYKLGSGSFSQDARGRWYANICVEVPVFVGPIKPPELCECVGIDLGLKDFATMSDGVKVEAQRLYRCAEAKLAVAQRANKKARVKAIHAQIANRRKDALDKLSTKLVCENRAIFVGNVNASGLAKTNMAKSVLDAGWTSFRTMLSYKSIATGVLFDEVNEAYSTQTCSCCGTLPDSRPRGIAGLGIREWTCSECGAHHDRDVNAAKNILQRGHALLAVGIPVL

SEQ ID NO: 2427 - protein, 538 aa, Unknown
  Description of Unknown: uncultivated organism sequence
  Category: MG81 effectors
  Description: MG81-710 effector
MDNEEKKEDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2428 - protein, 352 aa, Unknown
  Description of Unknown: uncultivated organism sequence
  Category: MG81 effectors
  Description: MG81-711 effector
MKTLKLRIKDKHSAVLNQMACEVNFVWNYVNDLGFKHLKRKGEFLSAYDIAKYTKGTSKECNLHSQTIQAVTEELVTRRKQFKKAKLKWRVTNKKSARRSLGWIPFKKIAIKYANGYVQYGKHQFRVWDSYGLSQYSVKTGSFVEDARGRWYVCLVVESSKTVKITSTKAIGIDLGLKDIATCSDDTVISNPKFYRKYEQKLGIAQRARNKKRVRALHAKIGNCRKDYLHKSSTMLVKKNALIVVGDLSAKKLVKTKMAKSVLDTGFSALKTMLKYKCENAGVLFEEVNERFTTQICSCCGEITTGSPKGRADLRIRVWECECGSINQRDLNSAKNILALGHKRLAVGISLF

SEQ ID NO: 2429 - protein, 350 aa, Unknown
  Description of Unknown: uncultivated organism sequence
  Category: MG81 effectors
  Description: MG81-712 effector
MIVVYRYRVKSLNGLLNKQSRAVNYVWNFCNDTQKHALKWGKKWPTGFDLNVLTTGSSKELGIHSGTVNATCEQYAKSRSQHRRPFLRYRGRRSLGWVPLKGRDLKREGQAFRFAGNTFRVFNSRPLPEGKIKDGTNFAQDARGNWFLNIVIEVADVPARPIRTGVGVDLGLKDFATLSTGEKLPNDRFGRCAAEKLAKAQRARKHKRHIAKLHAKVANARADFQHKLALDLVRRFDYIAVGNVSAAKLAKTRMAKSVYDASWSSFRDRLRYKAIAHGATFEEVNESGTTQSCSACGSKDCTTRPRGISGLRIREWTCSRCGVVLDRDTNAALNILRCGRASPAVGISCL

SEQ ID NO: 2430 - protein, 367 aa, Unknown
  Description of Unknown: uncultivated organism sequence
  Category: MG81 effectors
  Description: MG81-713 effector
MYQVLKLRIYRKHYVKLDKLSSAVNFVWNYVNDLCWQMWRRKRIFPSAYDIHEYTKGAGEELGLHSQTIQFIGEKHHQSRKQHKKVKLAWRTNRKDAKRKSLGWIPFKASAISHVKTYNTGKKALKSQVQLSCGKEKLILTVYDQYDLRRYNGFRTAEIVQDSCDDWYLCLLVKVEPKVCTATSEVGIDYGCKTAAICSNGDKLETKFTQQYAEKLATAQRAHKKKQARRINRKIKNKRADATHQFTGKLVKENRLIVAGNVKSSSFTSGKLAKSVYDANWFAINRQLEYKSRRAGCQFIKVDEKFSTQTCANCLQITNSSPKGVAGLGIREWICDCCGQLNDRDVNAAKNILRFGRETLAGGSPIL

SEQ ID NO: 2431 - protein, 349 aa, Unknown
  Description of Unknown: uncultivated organism sequence
  Category: MG81 effectors
  Description: MG81-714 effector
MLQVQLKLRPCKAQEQIYDQWLYNLASVYNFAVRKIELNAKDKIYFSKNDFQNLLANHGEKLGIPSHTIQGVLCTVHDAWKRCFKKTAGKPKLKGMRNKMSSIPFPDPIKAPKGNRITLPGLGSVRFHKQEISEGKIKCGRLIKRASGWYLCLFIDAEPNPIKRLAFGAIGIDPGFSNLLTTSDGEVIEHPRELEAAAERLGQAQRGHNKQLAARIQERIANRKKDRNHKLTTKLVSENVLIVWSKDAIKGIAKRFGKSVSSSSHAQIRQMLSYKMPKSGGTFIEVASKYSTKTCNECGNPTGPTGLAELSVRQWRCSACGAEYDRDVNAARNTLFAGAGCAHEELAYV

SEQ ID NO: 2432 - protein, 350 aa, Unknown
  Description of Unknown: uncultivated organism sequence
  Category: MG81 effectors
  Description: MG81-715 effector
MIVVYRYRVKSLNGLLNKQSRAVNYVWNFCNDTQKHALKWGKKWPTGFDLNVLTTGSSKELGIHSGTVNATCEQYAKSRSQHRRPFLRYRGRRSLGWVPLKGRDLKREGEAFRFAGNTFRVFSSRPLPEGKIKDSTNFARDARGNWFLNIVIEVADVHARPIRTGVGIDLGLKDFAALSTGEKLPNDRFGRRAAEKLAKAQRARKHKRHIAKLHAKAANARADFQHKLALDLVRRFDYIAVGNVSASKLAKTRMAKSVYDASWSSFRDKLRYKAIAHGATFEEVNESGSTQSCSSCGSKDSTTRPKGIAGLRIREWTCSVCGVVHDRDTNAALNILRCGRASPAVGISFL

SEQ ID NO: 2433 - protein, 358 aa, Unknown
  Description of Unknown: uncultivated organism sequence
  Category: MG81 effectors
  Description: MG81-716 effector
MTKTFSFRIKDSTSAKHLRAMARAVNYVWNYCNEIQKKAAHDNRRWVNWVMLNNLTSGCSKELRLHSQTIQAIGERFHASLKEAKFPTGKKKRFLRFRGRRSQGWIPFKASGIKLRDDVVVYQGRTFRFWKSRDIPSTIKCGNFSCDARGRWYVNLVCKYEETIVSKEDTVGIDLGLKSVATLSNGKKYDAQKFFRKYERKLVHHQRCNNGRQVRTIHAKIANSRKDFNHKVSHELTRDFNKIFVGDVGCLSLLKTKLAKSVSDASWGQLRTFIEYKAIARGGTYYVVDENNTTRTCSACGCLSGPSGLAGLRVREWQCKECGTVHDRDTNSAINIEQRGLLTLCSPLRTLSAKEEIL

SEQ ID NO: 2434 - protein, 386 aa, Unknown
  Description of Unknown: uncultivated organism sequence
  Category: MG81 effectors
  Description: MG81-717 effector
MAGDIPPNNDDQLNINTLYVHTTMNIQIKILSVRIKDKHAAVLRQMAFEVNQIFNLANEITSAAYGNAGFFGAQKPQWLSAFDVQKPLLKERKERGYTIPSHTVQEIAAIHGKARKQFKRSRLRWRVSGGSRRSLGWVPFKIGSAVWKNGAVRFAGRIFNVWDSYGLGGFKFRAGSFSEDSRGRWYFNVCVEVETVPSTATSAVGIDLGLKDYATPSEGDPLIAGRFYRDLEPALGKAQRANKKARVRAIHAKIKNRRKDALHKYSTALVNSHAAIFVGDASSKKLVKTKMAKSILDAGWFMLKTQLEYKAIARSVMFEVVNESYSTQACSCCGAISANSPKGRAGLRIREWTCCECGTTHDRDVNAAKNILAAGHRRLAVGIPFL

SEQ ID NO: 2435 - protein, 570 aa, Unknown
  Description of Unknown: uncultivated organism sequence
  Category: MG81 effectors
  Description: MG81-718 effector
MHGTSQSFSGVFCVQIRGVLRPVFGGWKALFRDLECNPLQICEFWPIINIITKKRGIPVKKCTTDTCCLTLPLKLEKWQEDCLAKRFEIARQIYNTLVRAEFKKLNELERTPEYNKILEQIHSLDWKGSGNRQRLNDLYRERNQILKNAKFTEYGFKSDMKFYYKHFSDNIGSCVAVHGIAPQVWAAFEKYLFKPEGKKVHFKRFGDVHSLRGYSKAGESGGAEITFCGTHIRWKNLELPIKLSPDNAYETEMLSRRVKYVRILRKPGKSKDRWYVQLSLEGKPAIKYDRNAGEIKHPVAHGAVGLDIGPQTLAYSAETTADLVELADQVQNIEQEKRRLQRKMDRSRRSTNPGNYNTDGTIRRGVKLTRNKSKAYCKLQRQLAYLQHTQAETRKRQHTELANYLLSLGDCFYVEEMKWSSLAHRAKETAVSEKTGRFKQKKRFGKSIANKAPSTLIGILQQKCESLGLPGIIYVPLSAKASQYNHLTGEYTPKPLSQRWNTMPDAQRVQRDLYSAFLLQHFDSQAGIYNLQSLQRDYPQFLQYHDQSIRRLSEMPKTLSSMGIRKSIRA

SEQ ID NO: 2436 - protein, 336 aa, Unknown
  Description of Unknown: uncultivated organism sequence
  Category: MG81 effectors
  Description: MG81-719 effector
MQTYHFRIKDSTHINWLCKKAGIVNHIWNEVQSFRLSFYNLFGDLFSEYDIHKICKFQNINSATVQLVIKNYIQKSKQFKKLKLKWRTSRKSLGWIPFDKRNFLFDYETGTATYMKRSFKLWYSQKVDGNVLCGSFNQDASGHWFLNITTDAVIEKERVCDREIGIDLGCKEQITCSDGVVYERENLTRKFADKLATAQRARKKRQVTKIHRKIKNIRNDWNNKVTTDICRTSKLVVVGNIIAKGLCKTRMAKSIFDVATFQIKSMLSYKAIRHCMDVLIVSEKFSTVTCSVCHEKTGPSGLSGLGVRAWDCPICGSHHHRDVNAAINILSSVRGI

SEQ ID NO: 2437 - protein, 538 aa, Unknown
  Description of Unknown: uncultivated organism sequence
  Category: MG81 effectors
  Description: MG81-720 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2438 - protein, 538 aa, Unknown
  Description of Unknown: uncultivated organism sequence
  Category: MG81 effectors
  Description: MG81-721 effector
MDNEEKEKDGATCCLTLPLKLEKWQSDHLEKRFEIARQLYNTLVHAELKKKCQVERMPEYQEIMKMIDTASNQKEKWALEKKRKAFLEENGFSGNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2439 - protein, 368 aa, Unknown
  Description of Unknown: uncultivated organism sequence
  Category: MG81 effectors
  Description: MG81-722 effector
MKTLKLRIRDKHTAKLNRLSGAVNFVWNYVNALSYEHLKRTGKFFSAYDLNEYTKGSGELVGLHSQTIQAINETHAKARKQFKKAKLSWRTNNPKSKRKSLGWLPFKKSAIKHIATYQTGKKGLKSTLQLSLAKGQKLIIDLWDSYNLSLYQINTLEIVQDSRNRWYACITVKEYPKTTCGTGSVGIDLGLKDSATASNGDKLQIKQTLKYAKQLAIAQRSNNKKRIKAIHAKIKHTRQDLIHKFTTQLVKDNALIVVGDVKTTQFNSKKGKLAKSVYDAGWFELKRQLTYKCENAGCRFEIVSERYTTQTCSCCGQIDRNSPKGRAGLRIREWTCAMCGTWHDRDINASRNILAVGLGRLGAGIPER

SEQ ID NO: 2440 - protein, 512 aa, Unknown
  Description of Unknown: uncultivated organism sequence
  Category: MG81 effectors
  Description: MG81-723 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMDYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDSFKKLHDTEIENIRNEVMLRERKNISSYGIA

SEQ ID NO: 2441 - protein, 360 aa, Unknown
  Description of Unknown: uncultivated organism sequence
  Category: MG81 effectors
  Description: MG81-724 effector
MEVTKMLVRELKLKPTKRQEATLNEWLWCLTGVYNWASRKIELDAQDKIYHRKLAFQNSLSGVSKKLDIPSHTIQATILQAYNAWERCFKKVSKQPKLKSVRNKLRSICFPDPLNGKRISENRISLPGLKSVRFYKQDLPEGSIKQARIVKRALGWYCQICIDTVHIFPVENTDEAVGIDTGFKDLAILSTGKKFSNGREFVKGQKRLAQAQRGGRKKLAARLYERISSRRKDYNHKVSRQIVQNFKEIYITNDNLRGQAKIFGKSVSDAGISQLRQFLIYKGAQHSRKVVLVDSKYTTMTCSICGSLTGPTGLSGLVVRTWKCGACGAQHDRDVNAAKVILKSGLGCSLGVLESSGGAR

SEQ ID NO: 2442 - protein, 338 aa, Unknown
  Description of Unknown: uncultivated organism sequence
  Category: MG81 effectors
  Description: MG81-725 effector
MNDLSFQVWRRKRVFLSAYDIHEYTKGAGEELGLHSQTLQAVGETHAKSRKQANRSKLHWRTNRKDAKRKSLGWIPFKASAVKVLRTYNTGKTALKSQVQLSCGKEKLILTMYDQYDLRRYTEIKTASVVEDICGNWYLCLTVKVNPVTANIATGEVGIDLGCKTAATCSNGDKLETKFTHQYAEKLATAQRAHKKKQARKIHRKIRNSRANATHQFTNLLVKNNRLIVIGNMKASTFTSGKLAKSVYDANWSEIERQLEYKCEHAGCLLVKVNENFSTQTCANCLQITNSSPKGVAGLGIREWICGCCGQLNDRDVNAAKNILRFGRETLAEGSPVI

SEQ ID NO: 2443 - protein, 387 aa, Unknown
  Description of Unknown: uncultivated organism sequence
  Category: MG81 effectors
  Description: MG81-726 effector
MIIPMQTKTLKLRIKDKHAAWLRGLAREVNQVFNFCNEVSAKASSPYNSKPRWLSGYDLQKLVAGSTKGEDALSIPSQTLQQVCEEYASRRKQFKKHKLRWRVSNPKSSKYSLGWLPFKKGTVVYKNGQIRYAGKLLSLWDSYSLGQFELRAGSITEDSRGRWYLNVVVQVESTNGNGTSILGIDLGLKEAASCSDGQVLKSRWFREMEQALATAQRSGKKMRTKAIHAKIANRRKDAMHKLSTKLVKENAAIFVGNVASAKLVKTNMAKSTLDAGWSMFKTMLEYKAQAAGVVFEEVNEAWSTQKCSACGSIEGPKGRKELYVRSWTCSCGAHHDRDVNAATNICAKGLAQLAISKAAEVEAGEPVLNKAQAEVGHGLPAEGILTL

SEQ ID NO: 2444 - protein, 377 aa, Unknown
  Description of Unknown: uncultivated organism sequence
  Category: MG81 effectors
  Description: MG81-727 effector
MNGASSTKTKVLRLRLKDKHAKLLRDLAREVNFVWNYCNELQITMFNRERRFLSGYDFPKFTRGATKEGLRLHSQTVQAIAEEYATPRRQFSKVRLSRRKSTGNRRSLGWIPFKKSAIQPAHGQVKFAGQWLSLWDSYGLEAYQIRAGNICEDARGRWYLNACVAVPSAEPRSSARRDVGIDLGLEDLVATSDGGKLSAPQFYRGLEPKLVIAQRAVKKHRVRAIHAKIANRRNDSLHQFSTRLVRGYDTIFVGNVNASALVKTTPYAKSVLDAGWSAFRTMLRYKCDFAGATFAEIDEAFSTQTCSACDSRSGPKGIAGLGIRAWKCSKCGAVHDRNVNAAKNILAAGRRRLAEGIPAPFRAREDVKNAVVLGKPL

SEQ ID NO: 2445 - protein, 383 aa, Unknown
  Description of Unknown: uncultivated organism sequence
  Category: MG81 effectors
  Description: MG81-728 effector
MIQCQLKLRLTKAQEATLEVWLFRLTGVWNWAVRKIELDARDKIYHSKYDLDAMLVGHCTRLEIPKQVLKCTIFTVHQAWMRCFKKLSKKPRLKGNRNRLNSIPFSAQILRPKAARIHVSGLGKVKFHKQEMPEGKIKCARIVRRASGWYYCLFIDAEPNAIPRKASGQIGIDAGFKNLLTASTGEIIEHPRELEAVAQRLGQAQRARNRKLTARIQERIRNRRKDRNHKISRQLVSENVLIAFSKDSHNRIAKRFGKSVASSGHGQLRSMLTYKSRAGGAVYVEPESRNSTKRCSNCGSLSGPTGLSGLAVRRWTCGCGAEHDRDCNAAINTLIVGLGMSHERAHKTPVRNPVPPSEVQVEELKHRKFIPEQAGFRRRKIWK

SEQ ID NO: 2446 - protein, 364 aa, Unknown
  Description of Unknown: uncultivated organism sequence
  Category: MG81 effectors
  Description: MG81-729 effector
MKTYQFRLKSTNQAKLSKMAGAVNFVWNYVNSVSKEYTEKKGVWLSAFDLQHLTKACSGELGLNAKTVQMICHEHVNRRKGSKRLQLAWRSKNRSLGWIPFSGQDLPLKGDVVKHIGIEFRFWKTREIEGKIKVGSFCQDARGRWYVNFTCESVNKEPVDSNISVGIDLGLKTIATLSDGRTLNRENITNKYADRLAMAQRAGKKRLTKTIHTKIKNVRKDWNHKQTTNIVNSYDTIVVGNVSSSKLKKTRMAKSVSDAGWADFKRMLAYKAIALGVQYKEVNESFSTVTCSICEGKTGPTGLSNLGVREWTCSTCGTIHLRDVNAAKNILRIGHNALLMESSNLGKMSKTMDKKQNDIDTGNG

SEQ ID NO: 2447 - protein, 390 aa, Unknown
  Description of Unknown: uncultivated organism sequence
  Category: MG81 effectors
  Description: MG81-730 effector
MNDPLMPLSFTRTLKFKVKAESYAWLNAAAVEVNQVFNFANQASYDARRRTDLKSKWLSGFDLCNLTSGATEYFERIGADTIQQVCTHYAQKRTAAKRLKLRWRVSRGARRSLGWMPFKAASLRRRGNALRFCGKTFRVFERERLADVKWRDGCFAQDAVGDWWLCLPVIVTAEQTIAPLESVGIDLGLKTIATTSDGEKLEAGRWTAGNAEKLAAAQRRGHKKQAKRIHRHTANQRKDALHKFSRKIVDSYQTIVVGDVSSTKLVKTKMAKSVLDSGWGMLKAQLQYKGQQAGRSVSVVSERNTTRACSSCEAFTGPAGLDMLVVRRWDCPACGAEHDRDINAARNILIAGSRCLTSVSGNESSDSPVPSSRLRKRRRETGTETARTAA

SEQ ID NO: 2448 - protein, 351 aa, Unknown
  Description of Unknown: uncultivated organism sequence
  Category: MG81 effectors
  Description: MG81-731 effector
MILVYRYRVKSPTKILDEQSRAVNYVWNFCNESQKSCLRLGKRWLSGFDLDYLTTGTSKELGLHSGTINSVCDQYAKSRKQKKRPFLRWRGKKSLGWIPFKGRNLKWKGDAFVFGGNTFRVFFSRPIPDGAIIRDGSNFSQDARGNWFLNVVLRLPDNPRRGIRTSVGIDLGLHDLAALSTGEKIENPRHLAKLADKLARAQRAGKKKQATNIHAHVKNARRDFQHKLSTCLVKQFDAIYVGNVSSSKLSKTRLAKSVLDAGWSSFRSMLAYKCDYAGGRFSEVNESFSTQVCSSCGCLPEGRPKGIADLGKRQWDCVECGSHLDRDLNSALNILHAGSGHRSPAEGIPAL

SEQ ID NO: 2449 - protein, 389 aa, Unknown
  Description of Unknown: uncultivated organism sequence
  Category: MG81 effectors
  Description: MG81-732 effector
MAEPILTQTIGVTLKLRPTCAQAATMQRWLWHLTAVYNWAVKTIERDAERRVYRSTFDMYALVNGHSRRLEIPRSAIRGTIGTAHNAWQRAFHRVSRRPKLKGRRRPLNSIAFSQANKRPIRGRRIYLAGLGEVRFHEQAIPDGKIVCLRVVKRASGWYVCLFMNAAPRTIPRVAAGQIGIDPGFSSLLTLSSGELIEHPKELKVAALRLAQAQRGKRRRLTARIQERIANRRKNRNHHLSRQLVAENTFIAFSKDRIKAIEKRFGKSTASAAHAQLRSQLRYKSLTGGTKFIEVPSRNSTRTCSACGALTGPTGWSGLTVRQWTCGCGAEHERDVNAARNTLFAALGTSVESRREAASGIASKATSRGSCLVAWGPLPCTTADLSTPI

SEQ ID NO: 2450 - protein, 913 aa, Unknown
  Description of Unknown: uncultivated organism sequence
  Category: MG81 effectors
  Description: MG81-733 effector
MSYLAAKYIDLGKGVYHFTMKDKLDMLNKNEAVTDLRFGIVSEKYEKGITSFDYERIKAEEELDRNIAAYVTFAADIFAKSVIKSDYRTKKDNNSDVLQYSDKEFRNSEVIRDNAEKNILQYWGGYSRWGTENSKLPENNKVSDFGKLDVSDLCIDIKKHLAGIRNSSVHYTTKIKNESAADGSNVKILFEKDLADINIIYADKYYSNNVWMFYSLEDINKLIAFLYKEKRVIRQVQIPSFSRILKRKAMQDVINEIFKDDFDENIVNPELKEKYRNSLYFMLKEIYYNAFIIQPELKEKFKDKIKTMKSELYNKLKTIDKKEYKALYCMLSNEESALKNFADRIYSVDGDNVSFADICKILMTDYNMQNQEKKNIESMEQKKKNKGKDENYKHFPLLLHKVLKELFIEYLKQTHELEFLRNNICIKSDVTMESFESQIKGVEIYKDLKEKIDKNNSLLDWYVIAHFLMPKQLNHLIGNIKNYIQFATNIDKRAESVKNLTGSGMVKRIQYYDDIVRTLEFSAQYIGKISNNINDYFNSEDEYVSFLSKYVGFINDKSEDVLTELKDFCREKINNGSQIIGIYYGGDNVIINRNVIYAQMYSNAEVFSNIYKKVTKNDIINYYEKQNDLKDVFKSGVCQNEDEQRSLCEFQQLKNRIELTELSTYADMVNDFMAQFVEWAYLRERDLMYFQLGIHYIRLFYSDNVLDEKYHKLSDNVIDIEEGALLYQIVAMYDYELRIFETDNSGNAKRIGQGGPGKSIPVFLKKYCNVTDVYECGLELFEDINQHEHIIRFRNDIAHMRYMSNQAMNIMSIVSNIYKSFFVYDTKLKKSISLVFKNILMRYGVIADLVFSYNNKNQSIKDDMDINIINIKNLKSDKYVYKIVNEDIVKQVEIEIRNQVFLEQLHNLLYFSR

SEQ ID NO: 2451 - protein, 364 aa, Unknown
  Description of Unknown: uncultivated organism sequence
  Category: MG81 effectors
  Description: MG81-734 effector
MNIQIKTLKVRIRDKHADVLNRMSFEVNQVWNAANETSAEFAWVPVPEVGYMNMQTSGFDLMKELKGIRKERSMIISARTVQEVIAVHAKTRKQFKKDKLRWRSSGGARRALGWVPFKSGSACWINGQVRFCGIYFKCWDSYGLSQYDFRSGCFSEDSRGRWYFNIVVHVEEEVRLSEGGQIGIDLGLKTTATCSNGVVLERKQFYRNLEEKLGKAQRANKKKLVKTIHAKIKNQRLDANHKFSRKIVNENSLIVVGNVSSSGLAKTKMAKSVLDAGWFMLKTMIDYKSKAMQSAFIEVNEAYTTQACSCCGCISSSSPKGRRDLDVREWTCAECGTEHDRDINAAKNILSLGHQRLAVGILSL

SEQ ID NO: 2452 - protein, 511 aa, Unknown
  Description of Unknown: uncultivated organism sequence
  Category: MG81 effectors
  Description: MG81-735 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIAGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2453 - protein, 511 aa, Unknown
  Description of Unknown: uncultivated organism sequence
  Category: MG81 effectors
  Description: MG81-736 effector
MAKCSTDTCCLTLPLRLEKWQEDRLAKRFEIARQIYNTMVRAELKKLRAMEQSEPYKANQEKIQALGWKTQADKQALKALYKERDKLLQDGGFSERGFKSDIKNYYKHFNNNIGSNVAVHGIAPQVWAAFEKMLFKKEGKKVHFKKKGDIRSLRGYSITRKSGGVEIIFRETYIEWKGLKLPLKLSPDNSYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 2454 - protein, 351 aa, Unknown
  Description of Unknown: uncultivated organism sequence
  Category: MG81 effectors
  Description: MG81-737 effector
MLHTKTLKVRVRDKHAPLLRQMARSVNFVWNYLNELSQRSIRERGGFLSAYDLHPYTKGAAKELGLHSQTLQCIAAEYVTRRKQFKKVRLNWRKSAGVRRSLGWIPINTGAASWKNGQVYHNGHYFKVWDSYGLAGHKFRSGSFSEDSRGRWYFNVVVDVEESVSMGQGSVGIDLGLKDIATCSDGRQLENNQFYRGMQQKLAIAQRSRNKARTRAIHAKITNRRKDALHKFSRKLVDSYGTIIVGNVSPSKLVKTKMAKSVYDAGWSMLKTMLEYKCDHAGIVFKEVNEAYTTRACSACGSLTGPRGVNGLRIREWTCCECGVAHDRDINAARNILALGHERPSVGIPVL

SEQ ID NO: 2455 - protein, 367 aa, Unknown
  Description of Unknown: uncultivated organism sequence
  Category: MG81 effectors
  Description: MG81-738 effector
MYQVLRLRIYRKHNAKLNKLASAVNFVWNYVNDLCLQMWQRKRVFPSAYDVAEYTKGAGEYLGLHSQTIQFIGEKHHQSRKQHKKVKLAWRTNRPDAKRKSLGWIPFKASAVKVLRTYNTGKTALKSQVQLSCGKEKLILTVYDQYDLRRYSGFRTAEIVQDSCGDWYLCLLVKVEPKICTAIGEVGIDYGCKTAATCSNGDKLETKFTRQYAEKLATAQRARKKKQARRIHRKIKNSRADATHKFTSKLVRENRLIIAGNVKSSSFTSGKLAKSVYDANWFAINRQLEYKSRRAGCQFIVVDENFSTQTCANCLQITNSSPKGVAGLGIREWICDCCGQLNDRDVNAARNILRFGRETLAEGSPVF

SEQ ID NO: 2456 - protein, 347 aa, Unknown
  Description of Unknown: uncultivated organism sequence
  Category: MG81 effectors
  Description: MG81-739 effector
MLQVQLKLRPCKAQEQIYDQWLYNLASVYNFAVRKIELNAKDKIYFSKNDFQNLLANHGEKLGIPSHTIQGVLCTVHDAWKRCFKKTAGKPKLKGMRNKMSSIPFPDPIKAPKGNRITLPGLGSVRFHKQEISEGKIKCGRLIKRASGWYLCLFIDAEPNPIKRLAFGAIGIDPGFSNLLTTSDGEVIEHPRELEAAAERLGQAQRGHNKQLAARIQERIANRKKDRNHKLTTKLVSENVLIVWSKDAIKGIAKRFGKSVNSSSHAQIRQMLSYKMPKSGGTFIEVASKYSTKTCNECGNPTGPTGLAELSVRRCSACGAEHDRDVNAARNTLFAGAGCAHEELAYV

SEQ ID NO: 2457 - protein, 365 aa, Unknown
  Description of Unknown: uncultivated organism sequence
  Category: MG81 effectors
  Description: MG81-740 effector
MDNQLPTKTLKLRIRDKHSNFLLAQSKEVNLVWNYVNDLSMQILKREQRFCSAYDLSKYTAGATKAGLSLHSQTVQAIGDEFVTRRKQFKKVKLKWRKSGGSKRSLGWIPFKSSAIRYKNGQVFYCGKAIGLWDSYGLSKYQLGTGSFSEDSRGRWYLNVTVKVNQKTESGGQLTGVDLGCKEAATASDGSQVHGRRYRALEQKLALAQRARNKYRIKNIHAKIKNQRKDDLHKFSSALVKRSGAIFVGNVSPTGMAKTKNAKSSLDAGWGILKSMLEYKCRWADVVFGEVNEAYTTQTCSCCGSISSSSPKGRADLGIRSWTCVVCGTHHDRDINAGINIAKRGESQFLVGAGHCPPVVGIPVL

SEQ ID NO: 2458 - protein, 347 aa, Unknown
  Description of Unknown: uncultivated organism sequence
  Category: MG81 effectors
  Description: MG81-741 effector
MLLAYRYRVKSLEGLLKAQSRAVNFVWNYCNETQKSALKWNKRWPSGFDLNKLTAGTSKELRLHAGTINSVCEQYANSRSQKKRPYLRWRGKKSLGWVPLKGRDLRREGDAFRFAGNTFRVFYSRPLPDGKIKDGTSFSCDARGRWFLNIVIEVAAATPRQVAAAIGIDLGLKDFAALSTGETIGNPRHLRKLAVDLAIAQRAGKKGRARSIHAKISNARADFHHKLSFRIVREFDYIAVGNINAAGLAKTNMAKSVLDAGWSSFRNQLRYKAIKHGAWFAEVSEYGSTRVCSSCACETGPKGVKDLGIRIWICSECGTSHDRDTNAALNILFRSGHRTPVEGIPVL

SEQ ID NO: 2459 - protein, 390 aa, Unknown
  Description of Unknown: uncultivated organism sequence
  Category: MG81 effectors
  Description: MG81-742 effector
MKSNNTLMPPLLMRTLRLKVRSEAYPWLNAAAIEVNAVFNYCNETSYKAATRTDLKRKWLSGFDLCSLTAGASQYFEKIGSDTIQSVCVQYAQNRKAAKKLKLKWRVSRGAQRSLGWIPFKAAALKRKGRGVRFAGKCIRVFERERLEGAKWQGGEFAQDSVGDWWLCLPVKVQAEETIAPQEAVGIDLGIKCIAATSDGDRLEAGRWTRRYAEKLASAQRRGHKRQAKRIHRKVARCRADALHKFSRTMVDRYQHIVVGDVSSLKLVKTRMAKSVLDSGWGTLRRFLAYKCEHAARGFEVTDERYTTVTCSHCGALSGPRGVNGLIVRFWVCRNCGELHDRDVNSARNTLIGSRCRTSVCGNKLSYSLISPSNAYRVREAEIELARTAA

SEQ ID NO: 2460 - protein, 351 aa, Unknown
  Description of Unknown: uncultivated organism sequence
  Category: MG81 effectors
  Description: MG81-743 effector
MKTFKFRLKRRNTAKLEKMAGAVNFVWNYANQTSVEYLDKFGKWLSGYDLNYLTVGCSKDLGINANSVQFVCEELAKRRKQSRRRKLSWRSQKRSLGWVPFKQDGILIKDDVITYYGNQFKFWKSRQIEGKIRGGSFTQDSKGNWYINIVCEVPRSIRIADNREVGIDLGLKTLATLSDGNKIDRFNITDKYADRLAMAKRANKKKRATAIHAKIKNTRKDFNHKETTKLVNNYGKIFVGDVSPSKLMKTNMSKIVTDVSWCDFKSMLAYKAIALGVEYKEVKENFSTVTCSTCFERTGPSGLSALGVREWTCKCGATHDRDVNAAKNILRFGHETPIKGSPYYKRNVSKR

SEQ ID NO: 2461 - protein, 511 aa, Unknown
  Description of Unknown: uncultivated organism sequence
  Category: MG81 effectors
  Description: MG81-744 effector
MREDSQNTCCLTLPLKIEKWQADRLIKRFEIARQIYNTLVHAELKKLQKMEASAEYRQIQDRIRELNPSDVRAKKEWKILKDKQEKLWKAWKITEYGFKSDIKAYYKYFNENIGSAVATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLEQKCKSLELDVVMVNTSLKASQYNHQTGKYEKKTLSQRWNHMPDGEQIQRDLYSAFLLQHVVPEKNAFDNEALCRDYPKFVQYHHEVIERLRSLPKTISSMGIRQSVS

SEQ ID NO: 2462 - protein, 353 aa, Unknown
  Description of Unknown: uncultivated organism sequence
  Category: MG81 effectors
  Description: MG81-745 effector
MKQTKTLRVRVRDKHAPLLRQMARSVNFVWNYLNELSWRAIRERGVFLSAFDLHPYTKGAGKELGLHSQTLQCIAAEYVTRRKQFKKSRLRWRKSGGARRSLGWIPLNTGAASWKHGQVFHNGHHFKVWDSYGLGDFRFRSASFSEDARGRWYFNIVVDVGTQLGTGQGVIGVDLGLKDVATCSDGRKLENGRFYRDLEAKLAVAQRAGNKERARAIHAKIANRRKDALHKFSRQLVNQHAEIYVGDVSSQKLTQTRMAKSVLDAGWGQLKAMLAYKCAHAGIVFKVVDERYTTQTCSCCGAKPDSRPRGIAGLGIREWTCSECGVTHDRDINAARNILAAGRGRPVVGIPVL

SEQ ID NO: 2463 - protein, 397 aa, Unknown
  Description of Unknown: uncultivated organism sequence
  Category: MG81 effectors
  Description: MG81-746 effector
MAAPVNAPHTTRVLRLRLKDRHADALRALAGEVNFVWNYCNELSTKGFQRERRFIGAYELHKYLSGAGKDGLQLHSQSVQAVADEFARRRKQFKKVKLRWRVSRGARRSLGWVPFKASAIQYKNGQVHLAGTPLSLWDSYGLSRYELGAGNISEDARGRWYLNVTVKSPGWPKSRNLEQVQGDAVGIDLGLKDFLATSEGELVEAQRFYRDLEPALAGAQRAHRARRVKALHAKIANRRKDFLHKLSTGLVRQHQAIFVGDVNARALARTTMAKSVLDAGWSAFRTMLQYKCDDAGVWFSEIDEKFSTQECGACGARTGPRGREGLSVRSWECSRCGTQHQRDVNSATIIRNRGLVWLEKAFSTPGEARADEAGVNEGALRAPAAGHGRPDVGIPAL

SEQ ID NO: 2464 - protein, 512 aa, Unknown
  Description of Unknown: uncultivated organism sequence
  Category: MG81 effectors
  Description: MG81-747 effector
MPTKQKEDSNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2465 - protein, 349 aa, Unknown
  Description of Unknown: uncultivated organism sequence
  Category: MG81 effectors
  Description: MG81-748 effector
MLQVQLKLRPCKAQEQIYDQWLYNLASVYNFAVRKIELNAKDKIYFSKNDFQNLLANHGEKLGIPSHTIQGVLCTVHDAWKRCFKKTAGKPKLKGMRNKMSSIPFPDPIKAPKGNRITLPGLGSVRFHKQEISEGKIKCGRLIKRASGWYLCLFIDAEPNPIKRLAFGAIGIDPGFSNLLTTSDGEVIEHPRELEAAAERLGQAQRGHNKQLAARIQERIANRKKDRNHKLTTKLVSENVLIVWSKDAIKGIAKRFGKSVNSSSHAQIRQMLSYKMPKSGGTFIEVASKYSTKTCNECGNPTGPTGLAGLSVRQWECNVCGAQHDRDINAAINTLAAAAGCAVEGYAYV

SEQ ID NO: 2466 - protein, 413 aa, Unknown
  Description of Unknown: uncultivated organism sequence
  Category: MG81 effectors
  Description: MG81-749 effector
MESSHARTFMLGWRLLRRPRKAMQPQDPTRPRIHSVTRTLRLKVKTESYAWLNTAAYEVNQVWNWSAEVSEKAARPCTGERKWLTGFDLNNLSAGASEYFDKIGADTIQRVNGEYAEQRRIAKRIRLRWRTSRGPRRSLGWVPFKAASLKRKGRSLRFCGKTFRVFEPERLEGVKWRQGEFAQDAVGDWWLCLRIKIQVEESVAPLEKVGIDLGLTEVAVTSDDARCEKSCFYRGIEQKIAQAQRRGHPRQAKFLHRRAANRRKDALHKFSRRIVNEYEKIVVGDVSSTQLVKTRMAKSVLDAGWGMLRTYLQYKSQQAGRTFQIVNERNSSRTCSNCDALTGPQGVNGLRVRRWTCAACGVSHDREVNAARNHLRRAELPASVRKRVIVLAGSAEPSIPLAQGRTEPVRTVA

SEQ ID NO: 2467 - protein, 378 aa, Unknown
  Description of Unknown: uncultivated organism sequence
  Category: MG81 effectors
  Description: MG81-750 effector
MHGASCTKTKVLRLRLKDKHAMFLRHLAGEVNFVWNYCNELQITMFNRERRFLSGYDFAKFTRGATKEGLHLHSQTVQAIAEEYATRRRQCRRVRLSWRKSTGRRRSLGWIPFKKTAIQAAHGQVKFAGRWLSLWDSYGLDAYPIRAGTICEDARSRWYLNACVAVPVAEPRSSARRDVGIDLGLKDLVATSDGEKVSAPQFYRGLEPKLAIAQSAGKKDRVRAIHAKIANRRKDSLHQFSTRLVRGYDTIFVGNVNTSALAKTSFAKSVHDAGWSAFRTMLRYKCDFAGATFAEVNEAFSTRTCSACDSRSGPKGIAGLGIRAWKCSKCGAVHDRNVNAAKNILAAGRRRLAEGIPALLGRGRTSNCGETVRRTILC

SEQ ID NO: 2468 - protein, 351 aa, Unknown
  Description of Unknown: uncultivated organism sequence
  Category: MG81 effectors
  Description: MG81-751 effector
MIQVQLKLRPNVKLEKRLDEWLWHLTGVYNWAVRKIQLDADDKIYHSPMNFQNLLAGHAKKVGVPGHCIQGVLSTVHAAWQRCFRKQGGRPKLKGQRNKLVSIPFPDPIRCPEGSHVKLPVLGLVRFHKQFLPEGRIKCGRLIKRASGWHLCLFIDAAPKEIERVGFGKIGIDPGFKSLLTFSTGEKVEHPRELEASAKRLAQAQRGKDKKLVARIHERIANQRKDRNHKLSRKLVAENTVIRFSKDNIKGIAKKFGKSVTSSGHGQLRAMLAYKSSHIGGTQYDEPASKNSTRICSNCGCLSGPTGWAGLSVRNWVCQECGSLHDRDQNAAINVLNFGAGTALERGLCQI

SEQ ID NO: 2469 - protein, 556 aa, Unknown
  Description of Unknown: uncultivated organism sequence
  Category: MG81 effectors
  Description: MG81-752 effector
MATRKKHIRTPYEDERKKHRAAASRHVLALEAQIKEDDKRKLFHIANDLRVYGNHLTNIAQKRVSQLFRTKAYREALKQYHNASSVLSSLDKGTPKYHEAKEKVKDAADVLERLQAQYKLTMEDLRHDMAGISKGGKIKAVFLLSETENVWAAVQSVLYKSGKHLNYAKRGELPLIRAKQIERGITLSFVNGVPRCKMGAIDDFALIVKKNDSFAKNELACIEAFVSDLETEKKAVAIFSKTGIPQNTYRPCFVALKCVTIRGKLRVYAHITVEGDPIPKYTKSGCLKHPCGKGLVGVDLGPQSVAAVSETSVILENLAERNGKSTKRHERKERLFLRALDRSRRANNKDRYNEDGTVKKGVHKPWKKSKQYRIKEACLKELRRKNALSRKYANNELANRIRAMGDDITIERSNVKALQKKAKPSVPEQGKKQKRRKRFGHSILHRCPGHLYAQLHSKFSENHFHVVDNMYRASQYDHKSNSYNKKKLSQRWHKFEDGTKVQRDIYSAFLLLCHNDDFKTINQDICILKYETFKKAHDKCISDIKTSGQKVCNSGI

SEQ ID NO: 2470 - protein, 383 aa, Unknown
  Description of Unknown: uncultivated organism sequence
  Category: MG81 effectors
  Description: MG81-753 effector
MPLSFTRTLRLKVRRESYAWLNAAAVEVNEIFNYCNETSLKAATRTDLKRKWMSGFDLCNLTAGSSQYFDKIGADTIPSICTHYAQKRQAAHRVKLRWRVSRGTRRSLGWVPFKAASLKHKGVCLRFAGKCFRVFERERLEGVKWQGGCFAQDAIGDWWLCLPVKVAAEETVAPEQAVGIDLGLKDIAATSDGGRLRAGHWTQEYAQKLAAAQRCGHKRQAKRIHRKVARCRTDALHKFTREIVDRYQKIVVGDVSSLKLVRTRMAKSVLDSGWGMLKRFLEYKSQQAARTFEVVNERNTSITCSTCGALSGPRGANGLIVRSWVCRDCGELHDRDVNAARNILIGSRYRTSMRGNESSPWLIPPSNAYCVREAGMESAWAAE

SEQ ID NO: 2471 - protein, 367 aa, Unknown
  Description of Unknown: uncultivated organism sequence
  Category: MG81 effectors
  Description: MG81-754 effector
MIQVQLKLRLRPAQERQLERWLFRLTGVWNWAIRKLEADGNVGVRHSVFEMKALVNGHGRKIGVPSKAMTALVAQACDAYDRYRGGLANRPRLKGRRNKLNSIPFDQGQLIRSDRSVYLAGLGLARFHPQEIPAGHSGCSRIVKRASGWYLCLFIQAEREPIAVVVDGLIGVDPGFSNLLTTSDGEIIEHPDELRAGELRVAQAQRGKRERLSARLRERGANRRRDRNHKLSRRLVAENRLIVWSKDNTAGIARSFGKSVSSASHSQLRQMLAYKSRAGGREFVEVASRNSTRICSACRAITGPTGYAGLSVRRWTCVCGATHDRDVNAAVNTLIAGLGMSHERSREVASGIVIESKPTRFMRGASQ

SEQ ID NO: 2472 - protein, 512 aa, Unknown
  Description of Unknown: uncultivated organism sequence
  Category: MG81 effectors
  Description: MG81-755 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2473 - protein, 372 aa, Unknown
  Description of Unknown: uncultivated organism sequence
  Category: MG81 effectors
  Description: MG81-756 effector
MNHTKTLKVRVRDKHAPLLREMARSVNYVWNYLNELSHRSIRERGVFLSAFDMHPYTKGAGKELNLHSHTLQCVAAEYAARRKQFRKPRLNWRKSGGVRRSLGWIPINTGAASWKNGQVFHNGHHFTVWDSYGLGQYRFRSGSFSEDSRGRWYFNIAVDVPEFVGPLQQTESIGIDLGLKEVATCSDGFTRLENARFYRGLEPALAIAQRANKKARIRAIHAKIANRRKEALHQFSRSLLKRCGMIIVGDVSPQKLVKTTMAKSVLDAGWGQLKTMLDYKCAHAGIVFKVVNEAYTTQTCSCCGAISSSSPKGRAGLRIREWTCECGVTHDRDVNAARNILALGLSVPQGESTSFRTGRKSKIRTEGHSRDS

SEQ ID NO: 2474 - protein, 380 aa, Unknown
  Description of Unknown: uncultivated organism sequence
  Category: MG81 effectors
  Description: MG81-757 effector
MLQVQLKLRPCKAQEQIYDQWLYNLASVYNFAVRKIELNAKDKIYFSKNDFQNLLANHGEKLGIPSHTIQGVLCTVHDAWKRCFKKTAGKPKLKGMRNKMSSIPFPDPIKAPKGNRITLPGLGSVRFHKQEISEGKIKCGRLIKRASGWYLCLFIDAEPNPIKRLAFGAIGIDPGFSNLLTTSDGEVIEHPRELEAAAERLGQAQRGHNKQLAARIQERIANRKKDRNHKLTTKLVSENVLIVWSKDAIKGIAKRFGKSVNSSSHAQIRQMLSYKMPKSGGTFIEVASKYSTKTCNECGNPTGLAGLSVRQWECNVCGAQHDRERRYQHPCCCGRMCRRGLRLCVAVQESQTSSLGASNTSLMFSYIRILSRENFNDVKH

SEQ ID NO: 2475 - protein, 347 aa, Unknown
  Description of Unknown: uncultivated organism sequence
  Category: MG81 effectors
  Description: MG81-758 effector
MIICHKYRVKSLTGFLNFQAKSVNFVWNYCNDIQRHALKWGKQWPTAFDLIKLTSGSSLHLGILAKTIEGVCQKYATSRGRCRKRFLRYRGQKSLGWVPISKSSLSILEGGFKFSGKLFRVFDSRQLPPDAKIKDGSCFSKDARGNWFLNIVIEIADLSCREITKGVGIDLGLKEFATLSTGEKINNPHHFRALEESLAKAQRARKKRQAANIHARISSARHDFHHKLSTRIIREFDYIAAGNIKAAGLAKTSLAKSINDAGWSSFRNMLRYKAIGRGAVYEEVSEYLTTQTCHECGSIAGPKGQTGLNERTWICTCGAVHDRDHNAAINILMRGSGHGTPVEGIAV

SEQ ID NO: 2476 - protein, 426 aa, Unknown
  Description of Unknown: uncultivated organism sequence
  Category: MG81 effectors
  Description: MG81-759 effector
MIVLAIALDEIGFEILAHAAEDRPQVFDGPIRQHVASVFGDKDQMDVHLENAMSAGPVVLHFALRPIMFRGMMLTFKYRVKDATVGKHLNRHAWACNQVWNFCVATQREAQRRRQAGLTVRWPSAFDLVKLCTGSGTELGLHSDTVQTICRQFAASRDLHKRCPRFRASGGPKRALGWVPFIPRAVKVDGAHVVYLKRKFHFWKSRDIDGEFKAGSFVQDARGRWYVCFQCEVAEDRPTGNGEIGIDLGLKTLATCSDGTSIPALRHYRQYEAALARESRAGNKRRVRAIHAKIANARRNHLHEWSTKLARENELIVVGNVSPSKLAKTKMAKSILDASWAMLRSQLEYKARRHRARFVEADERWTSQSCSDCGAVGGPKGIAGLGVRHWTCPCCGSSHDRDVNAARNILSVGAERRPPAVEIPVL

SEQ ID NO: 2477 - protein, 366 aa, Unknown
  Description of Unknown: uncultivated organism sequence
  Category: MG81 effectors
  Description: MG81-760 effector
MTEDNTVLKTLKVRVKDNRKNILNRMAFDINQVWNKANEITSEECYEPIPEVGYVFNNISAFDIQKRIKGIRKERDMIIGAGSAQKIIAIHAKARKQFEKVKLKWRTSGGSRKSLGFVPFKSGAIKWVNGQIRFCGYYFKVWDSYGLSKYDFRSGSFSQDARGRWYLSIVVKVQQEKSKGTGQIGIDLGLKTTAVCSDGTTLERKQYYRNMESKLAMAQRANKKKQVKNIHAKIKNRRADTNHKFSTKLVKENSLIVVGNVSSSKLAKTKMAKSVLDAGWYQLKSMLDYKSKGMQVCYVEVNEAYTTQACSCCGCISSNSPKGMDSLGIREWTCAECGTKHDRDINAAENILRLGHQTLAGGIPRF

SEQ ID NO: 2478 - protein, 338 aa, Unknown
  Description of Unknown: uncultivated organism sequence
  Category: MG81 effectors
  Description: MG81-761 effector
MKLLTYKYRIKDSTSKKRLEKMARSVNQVWNYCNEVSILALKSKFVFLTAFDLNKLTTGVSKELGINVETVQATCEEYATRRKQFKKQKLKWRSSKKSLGWVPFKARSIKYLGNGEVKYFGHVFKFWESRSPLNIKCGSFNQDSKGNWHLNLVCEVEDDFLESTGKSVGVDLGLKDLATYSNGEKFSGVKATKKYADKLAKAQRARKKKQVTNIHKKIANIRKDSLHKETSRLVKQYDLIVVGDVSSKKLLKTNMAKSVSDASWDTYKSMLLYKTIRFGKELKVVNESWTSKTCHVCNTVANFGGLSGLSVREWTCSSCNTTHDRDVNAAKNILRLGQ

SEQ ID NO: 2479 - protein, 377 aa, Unknown
  Description of Unknown: uncultivated organism sequence
  Category: MG81 effectors
  Description: MG81-762 effector
MEVEIANCIRTLRLKVKPEAYASLNAAAVEVNRVWNFANETSAKAARPFAGPPKWLSAYDLDKLTAGATKYFERIGSETIQRVNAEFATRHKQVKKTKLRWRSSRGSRRALGWIPFKAVQLKRKGTSLRFSGKAFRVFEQACLSEVKWKCGCFSQDAVGDWWLSLPVEVRAEPTVAQNEEVGLDLGLKNTVATSDGDKLEASNFYRNIEQKISQAQRRGHKRQAKRLHRRAARRRKDTLHKFSRKIVNRYQRIIVGDVSSAKLVKTRMAKSVLDAGWGMLKAQLQYKANQAGKCVFIVSERNTTRACSNCRALTGPAGLDMLAVRAWVCSGCGGTHDRDVNAARNIRFAARCSPSVSGNEPSPSDTPPSQASRLREA

SEQ ID NO: 2480 - protein, 386 aa, Unknown
  Description of Unknown: uncultivated organism sequence
  Category: MG81 effectors
  Description: MG81-763 effector
MFDETVYIDRAEAVLSARAPALCESPMKPDNAPETHIQRQTITFKFRLRDRHAAELNRQARAVNYVWNYVNETQQKAARAHRKWLTAFDLQRLTNGASKELDIHAHTIQRVCRAYDDARKTHKKAWLRWRGRKSLGWVPFNTGHVSFDGADFKFRGVAYTPMHLRDLKPGVKIGAGSFNQDACGHWFLNIPVEVECALSAPLSSVGIDLGLHTMATLSTGEKIEAPRLYRASEEKLGTAQRARKTKRARAIHAKVANRRKDFLHKASAKIAKQFGLIIVGDVSPSKLAKTNMAKSVLDAGWSGFKNMLSYKANYRGGAMVEVSERYSSQTCSACGSLPPSRPKGIAGLGIRRWTCDECGAIHDRDVNAARNIVRAGLRTLVGGAHV

SEQ ID NO: 2481 - protein, 351 aa, Unknown
  Description of Unknown: uncultivated organism sequence
  Category: MG81 effectors
  Description: MG81-764 effector
MILTYKYRIKNRNAKSALRRHVFAVNQVWNYCCAQQRDTESRYRAGAPKRKWASHYDLTRLCKGAGAMLGIHQQTVSGVCRTFAQARDKAKHAPAFRKSYGVKRSLGWIPFEGQSRQIKDGVVTYLGKRFYLWGLKRRPLPATVKGGAFVEDALGRWYVCLTVEIERKPATGDKAIGIDLGLKSFATLDDGRKIEAPRIYRRYEQRLAALQRAGKRCHTKRLHAKIKACRADFLHKVSTELAGQNAIIAVGNVNARALASKSVLDAGWSSFRKMLAYKANDYREVDEKFTTQDCSACGARCGPKGQKGLGIREWECSSCGVSHDRDVNAARNILALARSAPRPVEEYRRAA

SEQ ID NO: 2482 - protein, 339 aa, Unknown
  Description of Unknown: uncultivated organism sequence
  Category: MG81 effectors
  Description: MG81-765 effector
MELRECFQVWRRQRVFLSAYDIHEYTKGAGEELGLHSQTLQVVGETHAKARKQAKRSKLRWRTNRKDAKHKALGWIPFKSSAVKVIRTYTTGQKVLKSQVQLSCGKEKLILTVFDQYDLRQYTEIKTASVVEDSCGNWFLCLVVKIEPAIENTATDEVGIDLGCKTAATCSNGDKLETKFIQQYAEKLAIAQRAHKKNRAKRIHRKIKNKRTDATHKFTSRLVKENRLIVVGNVKSSSFTSGKLAKSVYDANWFAINRQLEYKCEHAGCLFIKVNENFSTRTCSHCLAMPDSAPRGIAGLGIREWICNCCGHLNDRDVNAAKNILRFGRETLAEGSPVL

SEQ ID NO: 2483 - protein, 362 aa, Unknown
  Description of Unknown: uncultivated organism sequence
  Category: MG81 effectors
  Description: MG81-766 effector
MIVLTYKYLVKGKRAKRQLRRASWAVNQVWNFCGQTQRSVQRAWKDGLSPRWPSRFDLAHLAAGTSKDLGIHGQTIQCVAAQFAKSRDQHRKCPRFRHSGGPKRSLGWVPFQAQSRQIEGNAITYLGTTYRFFASRPLPLIVKGGAFVEDARGRWWVCFHVGVANDLPAAPDVAVGIDLGLKTLATLSTGEKYEAPRHYRVWEDRLAVAQRANDKDRARAINAKIKNCRHDATHKWTTEVARNFRMIYVGDVSSSRLVKTRMAKSIYDAGWSGSKHALRYKASRHGGTCVEQDERLSTQICSSCGMLCETRPRGIADLGMREWVCSNCGTHHDRDVNAAKNILAFGLSAQPPVEESRVAHGR

SEQ ID NO: 2484 - protein, 538 aa, Unknown
  Description of Unknown: uncultivated organism sequence
  Category: MG81 effectors
  Description: MG81-767 effector
MDNEEKEKDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYKRIQHQYAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2485 - protein, 355 aa, Unknown
  Description of Unknown: uncultivated organism sequence
  Category: MG81 effectors
  Description: MG81-768 effector
MVTTIKLRLKDKHSTDLSRQSRTVNFVWNFVNETQRESVRRYRLGASGKFLSKYDYAKLCYGTGKELSVASGTIEEITRQYETSRRTHRKPWLRWRGRKSLGWVPFRGRQIRFDGEQFIFAKRKYRPMHLRDTLTPETKVLTGSFNADARGRWYINVTVELPDDTHPRAPDVPVGVDLGLKDLATLSTGAKVHNYKPYREREEELAKAQRANKKKRVRAIHAKIANSRKDTLHKASTEIARNHSLIFVGDVSSKQLARTRMAKSVLDAGWYDFKSMLTYKAIRHGGRMVEVDERYTTQGCSHCGLVGGPKGAKDLGMREWTCSGCGTNHDRDVNAARNILRVGTDTLEGGASNQS

SEQ ID NO: 2486 - protein, 522 aa, Unknown
  Description of Unknown: uncultivated organism sequence
  Category: MG81 effectors
  Description: MG81-769 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKMLLQRKLDRSRRATNPENYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2487 - protein, 538 aa, Unknown
  Description of Unknown: uncultivated organism sequence
  Category: MG81 effectors
  Description: MG81-770 effector
MNNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDSASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2488 - protein, 578 aa, Unknown
  Description of Unknown: uncultivated organism sequence
  Category: MG81 effectors
  Description: MG81-771 effector
MAFGSKNSTPSFVLTLPLDISLNEQDYLYKEFKKCGTIYNQLVSVTTKMWHQLRKMRKYRELMAAIAKAAPDSDEQKVLFKQREKMLKEYRFSEDAFHKLVVPYARHYAINSHIAQAVASDVWKAWNTFFFSKGKEVHYKRLDDLAAISGKNNFTGIVLRPANFTTSNIESAKRKAQKAVEKRYDDMYGRPDPKDDKKVVLPDEVKPQMEAEIAAAIAKIKPTIGKGNLRIVYGKHEFPVVLRNPKTQTGKYQQEALKCGVKYCRITRKWVKTKWKYYAQFILEGYPPTKCDGNGVMKHPVNQGRIGLDIGTQTLAISGKDICDLRVLAPSARAQARGLTNQIARTQRAMDRSRRVTNPKYYNPDGTIKRLKRQHGHKQRRDWKYSKRYFRLKAKLRDLNRRLADIRKMEHNILANELLQHGNEFVVEDMNYKALQKRSKETKTNAKTGRAHTKKRFGKSLSRCAPAMFISILNKKANRYGGSVIKVSTFETKASQFDHTDESYTKKRLSERMAHLSSGEVVQRDLYSAFLLEYIDTESLEYNTKALNSAFPAFLVMHENTIKHLQKDKSYLPASVGF

SEQ ID NO: 2489 - protein, 482 aa, Unknown
  Description of Unknown: uncultivated organism sequence
  Category: MG81 effectors
  Description: MG81-772 effector
MPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2490 - protein, 538 aa, Unknown
  Description of Unknown: uncultivated organism sequence
  Category: MG81 effectors
  Description: MG81-773 effector
MNHEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2491 - protein, 368 aa, Unknown
  Description of Unknown: uncultivated organism sequence
  Category: MG81 effectors
  Description: MG81-774 effector
MYKTLKLRIYTKHTPKLVKLASAVNFVWNYVNDLCLQMWRRNRVFLSAYDVSEYTKGAGEELGLHSQTLQAIGEKHYQSRKQHKKVKLAWRTNRKDAKRKALGWIPFKASAVSHVKTYKTGKKALKSQVQLSCGKEKLILTVFDQYDLRQYTEIKTASVVENSCGNWYLCLTVKVEPAIENTATGEVGIDLGCKTAATCSNGDKLETKFTQQYAEKLATAQRAHKKKQVKRIHRKIKNKRTDATHKFTSSLVKENRLIVAGNVKSSSFTSGKLAKSVYDANWFAINRQLEYKSRRAGCLLIKVNEKFSTQTCSNCLQITNSSPKGVAGLGIREWICDCCGTKHDRDVNAAKNILRFGRETLAGGSSVL

SEQ ID NO: 2492 - protein, 405 aa, Unknown
  Description of Unknown: uncultivated organism sequence
  Category: MG81 effectors
  Description: MG81-775 effector
MKKQDVSSHRRSAPAEAPVKRNEPNAGLFTRTLRLKVRPESYAWLNMAALEVNSVWNFANERASTALGNLGKWLSGFDLNNQTSGATEYMKYIGADTIQRVNGEYAAKRNAARKQKLRWRVSRGAHRSLGWVPFKAASLKRKGNALRFAGKTFRMFESERLDSVKWRQGCFAQDALGDWWLCLPVIAEAAQSVAPREAVGIDLGLKAVATTSDGDALEAARFYRGAEQKIAQAQRRGHKRQAKRLHRKAARRRVDALHKFSRKIVDQYQKIVVGDVSAPKLARTWMAKSVLDSGWGMLKAQLLYKGEHAGRTVEVVDERYTTRACSACGSLSGPQGPDMLVVRRWTCADCGASHDRDVNAARNILRRAEVSASVSGNESCDSLVPPRGKRIRRREAGTKTARHAA

SEQ ID NO: 2493 - protein, 365 aa, Unknown
  Description of Unknown: uncultivated organism sequence
  Category: MG81 effectors
  Description: MG81-776 effector
MLFIHRPGIITVMVQCQIKLCLTRAQEAELDRWLWHFTGVYNWAIRKIGCDAAGGIYYRKRDFQNLLAGHGRKLGIPFHTLQGVLVQVRTASDRCGKRLDKNPRLKGHRNRLNSIPLPDPIKRPDGCRIKVPSIGSIRFHKQDIPDGRIKCGRIIKRASGWYLALSVDAQPNIVRTFKMKAHREVGIDSGYMAIVTLSDGERVDAPKECSAMEKRLTQAQRSGNRKLVEQLHEGIVSRKKDRNHKLSRYLVGTCAVMTFVHDNNQALQQKPGKSVANANIHQLQKMLAYKSSSFGRWFELMDGSWSTRTCSAYGSLAGPKGRHGLSVRRWVSEAYGASHERDIDTARNALISAVGSVVEEARDAA

SEQ ID NO: 2494 - protein, 357 aa, Unknown
  Description of Unknown: uncultivated organism sequence
  Category: MG81 effectors
  Description: MG81-777 effector
MSIVQYQLKLILRPAQERQLRRWLWHLTGVYNWAVRKIELDAADRRYWSTYSLEALLVGHSRRLGIPARVLERTARQGHDAWRRCFSKLGGQPRLKGRRNRLNSIPFPDPIAFFTGRRVRVSGLGSLKCHYQAIPPGRIKASRIVRRASGWYLCLFVEAEPRAIELNGNGEVGIDPGFGSLLTLSTGEKIEHPHELKETAIRLAQAQRGYRKRLTARLQERIGNQRKDRNHKLSRRLVAENAVIGWSKDAHQNIAKRFGKSVASAAHGQLRQMLAYKSRAGGREFIEVPSRNSTRACSACRALTGPTGWRGLKVRQWVCVGCGCEHDRDVNAALNTLIAARGLRVEKPGDGPSGMAA

SEQ ID NO: 2495 - protein, 364 aa, Unknown
  Description of Unknown: uncultivated organism sequence
  Category: MG81 effectors
  Description: MG81-778 effector
MKTLKLRIKDKHANQLNTLAGAVNFVWNYVNDLSFKHLQRTNHFFSAYDIAAYVKGSGELLNLHSQTLQAITETHAKSRKQFKKAKLNWRTNNPKSKRKSLGWIPFKKTAIKYLGVKKAGKKSLKSTIQFSLAKGKKLTIDVWDSYNLALYTINTCELVQGSRGHWYACITVKEYPKIECGTGETGIDLGCKDSAMTSNGEVLKTKVTQQYAKKLGIAQRAKNKQRVKAIHAKIKNTRQDLIHKFTTNLAKTNKIIIIGKLQSKSFTRGKLAKSVYDACWFEIKRQLTYKCENAGCYYDEVNESYTTQTCSCCGSRQNSPKGRTGLGIREWLCECGVTHDRDINAAKNILALGLERLAVGIPSL

SEQ ID NO: 2496 - protein, 349 aa, Unknown
  Description of Unknown: uncultivated organism sequence
  Category: MG81 effectors
  Description: MG81-779 effector
MLQVQLKLRPCKAQEQIYDQWLYNLASVYNFAVRKIELNAKDKIYFSKNDFQNLLANHGEKLGIPSHTIQGVLCTVHDAWKRCFKKTAGKPKLKGMRNKMSSIPFPDPIKAPKGNRITQPGLGSVRIHKQEITEGKIKCGRLIKRASGWYLCLFIDAEPNPIKRLAFGAIGIDPGFSNLLTTSDGEVIEHPRELEAAAERLGQAQRGHNKQLAARIQERIANRKKDRNHKLTTKLVSENVLIVWSKDAIKGIAKRFGKSVNSSSHAQIRQMLSYKMPKSGGTFIEVASKYSTKTCNECGNPTGPTGLAGLSVRQWECNVCGAQHDRDINAAINTLAAAAGCAVEGYAYV

SEQ ID NO: 2497 - protein, 358 aa, Unknown
  Description of Unknown: uncultivated organism sequence
  Category: MG81 effectors
  Description: MG81-780 effector
MIQYQRKLKLTKVQEAQLNTWLFHLTSVWNWAIRKIELDARDKVYYSRKTFQNLLTGHSGKLGIPSHTIQGMLDQTWLSWQRCFKKISRKPRFKGRRNKLNSIPFPDPIKPPLNNRVRMPLLGLVKFHKQDIPEGKINSGRIIKRASGWYLCLNINAQPNVIPHVSDDQVGIDPGYVTLLTLSTGEKIEHPKELQNNLIRLGQAQRGINRKQVARLHERIKNQRKDRNHKISRELVSKNQVIAISKDNLGGLARSGFGKSVGAAAHGQLRSMLSYKCRAGGREYIEVPSKFSTMTCSTCGARSGPTGKSGLKVRYWECNVCGTVHDRDVNAAINTLIAGLGISHESYREVASEIREVA

SEQ ID NO: 2498 - protein, 369 aa, Unknown
  Description of Unknown: uncultivated organism sequence
  Category: MG81 effectors
  Description: MG81-781 effector
MIQVQLKLKLKREQETMINEWFPILTSIWNWAIKKIEKDAADHIYYNKFEFINILAGHNKRLGMPSHTIQAMLKDAHTTWQRCFKKLARAPRLKGQRNRLTSISFPDPIKEAHINRTYVELPYLGKLKYHKQRIPIGKVKCARLVKRASGFYLCLFIDAQSNRIAHKGCELIGIQLSVDGRMALSNGDIIQREAQLQKHLNRLAQAQRGGNKKLVARLHERIANCRKDANHKLSRKIVEQYDTIVVNKDDLKQRARNLGLLVADSANYQLRLMMCYKSENNERKYIEFASKTGTDNAMISTVTCSVCRSPSGPASLTCLKVREWVCVSCGTLHDRDVNTAKNTLIAGLGASHESDASRVRNLLTSHYEL

SEQ ID NO: 2499 - protein, 355 aa, Unknown
  Description of Unknown: uncultivated organism sequence
  Category: MG81 effectors
  Description: MG81-782 effector
MKTLKLRIKDKHCKVLNQLASEVNFVWNYVNDLCFKHLQRKGQFFSAYDVAKYTKGTSKECNLHSQTIQAVTEELVIRRKQFKKAKLKWRVSNKKSARRSLGWIPFKKVAIKYADGYVQYGKHQFKLWDSYGLSKYTVKTGSFVEDSRGRWYVCLVVDSSKQEKLTATKAIGIDLGLKNIATCSDGTVIFNPKFYRQYEQKLGIAQRAKNKKRVRALHAKIKNCRKDHLHKASSILVKNNALIVIGDLSASKLVKTKMAKSVLDTGFSALKTMLKYKCENAGVLFEEVSEKFTTQVCSSCGEITASSPKGRADLRIREWRCCNEKCLSLNDRDINAALNILALGHKRLAVGISLF

SEQ ID NO: 2500 - protein, 355 aa, Unknown
  Description of Unknown: uncultivated organism sequence
  Category: MG81 effectors
  Description: MG81-783 effector
MKTLKLRIKDKHCKVLNQLASEVNFVWNYVNDLCFKHLQRKGQFFSAYDVAKYTKGTSKECNLHSQTIQAVTEELVIRRKQFKKAKLKWRVSNKKSARRSLGWIPFKKVAIKYADGYVQYGKHQFKLWDSYGLSKYTVKTGSFVEDSRGRWYVCLVVDSSKQEKLTATKAIGIDLGLKNIATCSDGTVIFNPKFYRQYEQKLGIAQRAKNKKRVRALHAKIKNCRKDHLHKASSILVKNNALIVIGDLSASKLVKTKMAKSVLDTGFSALKTMLKYKCENAGVLFEEVSEKFTTQVCSSCGEITASRPKGRADLRIREWRCCNEKCLSLNDRDINAALNILALGHKRLAVGISLF

SEQ ID NO: 2501 - protein, 1330 aa, Unknown
  Description of Unknown: uncultivated organism sequence
  Category: MG81 effectors
  Description: MG81-784 effector
MKREKNITIMKISKVNHRRTAVALNGDKSELGGILYEAPVQKDKNGNYNDVIAETGKVVNEALDKKSRLYTPFNNQKVIIDKNLQRYANNLKRCYINFVKQYVNNKSFNYKAMQFIPDIQNPKTNDAVNYRTDRDNVYNKNKYYDKQTKSKSKKFIYEKIVIPQNEQNIVISALVNCSLRKSLRKDVSYKTKSGEIKTYNLPELVKKSMRFYCLEGQREPDEKEKYEMYILFSYMKEDKRTKNTDLLVKSISNQNTKVKVEDIDGNKLLKLSIADTKKKPLWEYLIKYADSSRQRELMYDIRKKIILYVAGIEEYENIKEDSGLSKVSWSKYNISDNKMFFDINSCTDKRKQNLEIKIREANIEHYRNASSKLCDDESIFWFQHFEGVIETLFSKKSKISEERLGCAYICDYLWKDFLSYLATKYIDLGKGVYHFTMKDKLDMLNKNEAVTDLRFGIVSEKYEKGITSFDYERIKAEEELDRNIAAYVTFAADIFAKSVIKSDYRTKKDNNSDVLQYSDKEFRNSEVIRDNAEKNILQYWGGYSRWGTENSKLPENNKVSDFGKLDVSDLCIDIKKHLAGIRNSSVHYTTKIKNESAADGSNVKILFEKDLADINIIYADKYYSNNVWMFYSLEDINKLIAFLYKEKRVIRQVQIPSFSRILKRKAMQDVINEIFKDDFDENIVNPELKEKYRNSLYFMLKEIYYNAFIIQPELKEKFKDKIKTMTSELYNKLKTIDKKEYKALYCMLSNEESALKNFADRIYSVDGDNVSFADICKILMTDYNMQNQEKKNIESMEQKKKNKGKDENYKHFPLLLHKVLKELFIEYLKQTHELEFLRNNICIKSDVTMESFESQIKGVEIYKDLKEKIDKNNSLLDWYVIAHFLMPKQLNHLIGNIKNYIQFATNIDKRAESVKNLIESGMVKRIQYYDDIVRTLEFSAQYIGKISNNINDYFNSEDEYVSFLSKYVGFINDKSEDVLTELKDFCREKINNGSQIIGIYYGGDNVIINRNVIYAQMYSNAEVFSNIYKKVTKNDIINYYEKQNDLKDVFKSGVCQNEGEQRSLCEFQQLKNRIELTELSTYADMVNDFMAQFVEWAYLRERDLMYFQLGIHYIRLFYSDNVLDEKYHKLSDNVIDIEEGALLYQIVAMYDYELRIFETDNSGNAKRIGQGGPGKSIPVFLKKYCNGTDVYECGLELFEDINQHEHIIRFRNDIAHMRYMSNQAMNIMSIVSNIYKSFFVYDTKLKKSISLVFKNILMRYGVIADLVFSYNNKNQSIKDDMDINIINIKNLKSDKYVYKIVNEDIVKQVEIEIRNQVFLEQLHNLLYFSR

SEQ ID NO: 2502 - protein, 352 aa, Unknown
  Description of Unknown: uncultivated organism sequence
  Category: MG81 effectors
  Description: MG81-785 effector
MKTLKLRIKDKHYKVLDQLALEVNFVWNYVNDLGFKHLKRKGEFLSAYDIAKYTKGTSKECNLHSQTVQAITEELVTRRKQFKKAKLKWRVSNKKSARRSLGWIPFKKVAIKYADGYVQYGKHQFKLWDSYGLSKYNVKTGSFVEDSRGRWYVCLVVDKTKQVKSKGNTSIGMDLGLKDLVTCSDGVKLKAPQIYRQYEQKLGIAQRARNKKRVKAIHAKIRNIRQNTLHQFSHKLVNKHAAIFVGNVNAKALARTKLAKSVLDASWTTLRTMLKYKCENASVWYKEVNEAYTTQTCSSCGSRCSSPKGRTGLGIREWQCMECGTFHDRDINSALNILALGHERLAVGIPVL

SEQ ID NO: 2503 - protein, 514 aa, Unknown
  Description of Unknown: uncultivated organism sequence
  Category: MG81 effectors
  Description: MG81-786 effector
MGNSSTDTCCLTLPLKLEKWQEDRLAKRFELARQIYNTLVRAELKKLERVKHSAPYREIQGQIQALDWSNPNDKGALRRLYKARDALLKSAGFTEYSFKSDIKYYYKHFSDNIGSNVAIHGIAPQVWTAFDKVLFNGGKKVHYKRYGDVSSVQGYSKTRKSGGTEIMFRGTYIEWKGLKLPLKLSPDNAYENEMLRYRIKFVRLVRKPGKQKDRWYAQLALEGKPVVKREPVTGEAVHPVGSGVVGLDIGPQTLAYSAPGEAGLVELADQVQNIEQAKCRLQRKLDRSRRATNPDNYSEDGTIRRGVKLTRNKSKRYRKIQNQLKYLQYCQAETRKRQHTQLANYLLSLGDSFYVEDMPWPALARRAKETVVSEKTGRIKRKKRFGKSIANKAPATLTRILNQKCTSLGLPGVVEVPTSVRASQYNHQTGEYIKKPLSQRWNNMPDGQRIQRDLYSAFLLQHYDPGTGTFDSASLQRDYPQFTQYHHQAIQHLLSMPKTLSSMGVRQSVRQYKA

SEQ ID NO: 2504 - protein, 381 aa, Unknown
  Description of Unknown: uncultivated organism sequence
  Category: MG81 effectors
  Description: MG81-787 effector
MLIIFVNKGSTSLIQVQLKLKLTHTQETMIQEWFPILTSIWNWAIKKIELDAADHIYYNKFEFVNMLANHNKRLGIPSHTIQAILKDAHTTWQRCFKKLARAPRLKGQRNRLTSVSFPDPIKKAHVNSTSIELPYLGKLKFHKQIIPSGNIKCARIVKRASGFYLCLFVDAQSNRIAHKGCEAIGIQLSVDGRMALSNGDIIQREAQLQKHLNRLAQAQRGGNKKLVARLHERIANCRKDANHKLSRKMVEQYDTIVVNKDDLKQRARNLGLLVADSANYQLRLMMCYKSENNDRKYIEVASNTSTAGATISTVTCSVCRSPSGPTSLTCLKVREWVCVSCGTLHDRDVNTAKNTLISGLGASHESAAKRVRNLLTNHYEL

SEQ ID NO: 2505 - protein, 348 aa, Unknown
  Description of Unknown: uncultivated organism sequence
  Category: MG81 effectors
  Description: MG81-788 effector
MIQAQLKLRLNTKQDAILTGWLWNLTGVWNWAVKKIELDAKDKIFYSPKEFHNLLAGHSEKMEIPSHTLQGMLSQAHLAWSRCFKKLAKKPHLKGLRNKLNSIPFPDPLRAPVGNHIAVPGLGSVRFHRQDIPEGKIKCGRIVKRASGWYLCLFIAADREPIAHTAHGQIGIDPGFKSLLTTSEGEIIEHPRELEAGAQRLAQAQRGNDRTLAARLQERMGNRRKDRNHKLSRQLVAENDLIAFSADNHKGVANKFGKSVSSSSHYQLRRMLSYKSRAGGTEYVEVDSKFSTKTCSNCGSLSGPTGWAGLSIRQWRCTECGTLHDRDVNAARNTLQAALGTRVEVCCA

SEQ ID NO: 2506 - protein, 538 aa, Unknown
  Description of Unknown: uncultivated organism sequence
  Category: MG81 effectors
  Description: MG81-789 effector
MNNEEKEKDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVCILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 2507 - protein, 536 aa, Unknown
  Description of Unknown: uncultivated organism sequence
  Category: MG81 effectors
  Description: MG81-790 effector
MNDEKYKKLLKQYHKLSDRHILVVETDMPYPDVLKVIALSDKIRKAGNELVSLMRKNYDQLMRTKKYRKLLKLYGNTKDKDKRKAIANQLNDMQKSYNVTWNFCRTSMIPIGKKYSIDAVFALTKAEDIWRGMEKCLYDNGKTIHLSKYGKLPCIRAKQIDRGIPMFVEDSKLRFKLKKMQFGIQVNDRFQSDEANAVLSYLENSDKMDADAVNTLIEEACCIDTYRPCYATLVPRLIRGKYRVYLHLTIEGKAKPKYDKFGNPRHKYGKGMIGADIGTQTVAYTSDTEVGLKNLSERGNSIQTSERKERLYYRAMDRSRRATNPQNYNPNGTIKKGKKTWKYSNHYKKLKAKHAELCRVNAVNRQLAINEDANYLRSLGDTFVTEPKNASKLMKRAKKTTVNSKGKFNKKKRFGKSIKNRCPSGFQTTVEKKFKITGGTYIEVPNNYRASQYDHTADDYIKKKLSDRLYRLRDETLVQRDWYSSFLLYCYDYRTQNIDKDKCITDFGRCYDKEKALIAWIKANHIKILNSGIKVT

SEQ ID NO: 2508 - protein, 380 aa, Unknown
  Description of Unknown: uncultivated organism sequence
  Category: MG81 effectors
  Description: MG81-791 effector
MRFFCEEKTRAGGKMIQRQLKLKLTPAQQRKCEAWLFRAAGIYNWTIRKMEQDAHGGKYWTAYGLIYEIAGHSKKCDVPAKIIQGTVARAHQAWERCYKKLSKKPRLKSARNKMSGLDIPSDVRRACERITIPGLGKVRYHKDMLPEGKIKACRILKKTSGWYLAVCLEAAPNTIQRTASGRIGIDPGFSSLLTTSDGVKFEHPREMEASAARLARAQRGGHKRTAARIQERIANQRRDRNHKLSRKLVRENELIVFSADRHKAIAKMFGKSVASSAHAQLRSMLAYKSRTGGTRYVEVDSRFSTKTCSACGCLSGPSGFSGLAVREWTCTECGTRQDRDVNAALNTLLSGAGRASKSEIAFCERRESDARMKRASAAQT

SEQ ID NO: 2509 - protein, 511 aa, Unknown
  Description of Unknown: uncultivated organism sequence
  Category: MG81 effectors
  Description: MG81-792 effector
MAKCSTDTCCLTLPLRLEKWQEDRLAKRFEIARQIYNTMVRAELKKLRAMEQSEPYKANQEKIQALDRKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYNPQTNTFDANSLHQDYPQFVQYHHDAVLRLYAMPKAPSSMGIKRSLR

SEQ ID NO: 2510 - protein, 578 aa, Unknown
  Description of Unknown: uncultivated organism sequence
  Category: MG81 effectors
  Description: MG81-793 effector
MAFGSKNSTPSFVLTLPLDISLNEQDYLYKEFKKCGVIYNQLVSATTKMWHQLRKTRKYRELMAAIAKATPDSDEQKTLFKQREKMLKEYRFSEDAFHKLVVPYAKHFAINSHVAQNVASAVWTAWEGFFFSKGKAVHYKKLEDVASISGKNNATGIVLRPANLTTSNIESAKRKAQKAVEKRYDDMYGRPDPKDDKKVVLPDEVKPQMEAEIAAAIAKIKPTIGEGSLRIVYGKHEFPVVLRNPKTQTGKYQQEALKCGVKYCRITRKWVKTKWKYYAQFILEGYPPTKCDGNGVMKHPVNQGRIGLDIGTQTLAVSGNDICDLMVLAPSARAQAKSLVNEIARTQRAMDRSRRATNPKYYNPDGTIKRLKRKYGQKQKRDWKYSKHHYRLRAKLRDLNRRLADIRKMEHNILANELLQHGNEFVVEDMNYKALQKRSKETKTNAKTGRAHTKKRFGKSLSRCAPAMFISILNKKANRYGGSVIKVSTFETKASQFDHTDESYTKKRLSERMAHLSSGEVVQRDLYSAFLLEYIDTESLEYNTKALNSAFPAFLVMHENTKRRLQAVGSSLPASIGF

SEQ ID NO: 2511 - protein, 369 aa, Unknown
  Description of Unknown: uncultivated organism sequence
  Category: MG81 effectors
  Description: MG81-794 effector
MSASVQNARVPTGTRSGSVIQVQLKLRPNVKLEKRLDEWLWHLTGVYNWAVRKIQLDADDKIYHSPMNFQNLLAGHAKKVGVPGHCIQGVLSTVHAAWQRCFRKQGGRPKLKGQRNKLVSIPFPDPIRCPEGSHVKLPVLGLVRFHKQFLPEGRIKCGRLIKRASGWHLCLFIDAAPKEIERVGFGKIGIDPGFKSLLTFSTGEKVEHPRELEASAKRLAQAQRGKDKKLVARIHERIANQRKDRNHKLSRKLVAENTVIRFSKDNIKGIAKKFGKSVTSSGHGQLRAMLAYKSSHIGGTQYDEPASKNSTRICSNCGCLSGPTGWAGLSVRNWVCQECGSLHDRDQNAAINVLNFGAGTALERGLCQI

SEQ ID NO: 2512 - protein, 368 aa, Unknown
  Description of Unknown: uncultivated organism sequence
  Category: MG81 effectors
  Description: MG81-795 effector
MKTLKLRIRDKHIAKLNHLSGAVNFVWNYVNDLSYKHLKKTGKFFSAYDLNDYTKGSGELVGLHSQTIQAINETHAKSRKQSKKAKLSWRTNNPNAKRKNLGWLPFKQSAIKHIATHQTGKKGLKSTLQLSLAKGQKLIIDLWDSYNLSLYQINTCELVQDSRNRWYACITVKDYPKKSCGGGSVGIDLGLKDSATASNGDKLQIKQTLKYAKDLAIAQRAKNKKRVKAIHAKIKNTRNDLIHKFTSQLVKDNALIVIGDVKTTQFNSKKGKLAKSVYDAGWFELKRQLTYKCENAGCRFEIVSERYTTQICSCCGEISANSPKGRANLGIREWTCAKCGTWHDRDINASKNILAVGLHRLAEGIPSL

SEQ ID NO: 2513 - protein, 371 aa, Unknown
  Description of Unknown: uncultivated organism sequence
  Category: MG81 effectors
  Description: MG81-796 effector
MRIVYHMKSKTQIKTLKVRIKDKHAAILNQWAFEVNQVWNAANELSADYSWVPIPEVGYINCGTSEYDLQKELKTIRAERNFSISAVTIQSVISQHAKSRRQFKKNKLQWRCSSGSKRSLGWVPFKSAGVKFINGQVRFCGKLFSIWDSYDLSKYELGTGSFSQDSRGRWYFNTTIKVEIKSSEGKTSVGIDLGLKTIATCSDGTVFERRRITDEFAKELATAQGAKKKNRVRAIHAKIKNTRSDAIHKFTTTMAENYGAIFIGDVSSKKLTKTKMAKSVLDAGWGMLKTQLKYKAIARSVMFEEINEKYTTQICSCCGVISGNSPKGRAGLGIREWICCECGAIHDRDINAAKNILALGHERLAVGISVL

SEQ ID NO: 2514 - protein, 358 aa, Unknown
  Description of Unknown: uncultivated organism sequence
  Category: MG81 effectors
  Description: MG81-797 effector
MILTFKYRIKDATVGKYLDRHSRSVNFVWNYCCETQRKVEAYYKAGAPKRRWPSHFDLVKLTTGCAAELGLHSDTVGQICKQFVISRNAARHAPRFRASRGPKRALGWLPFIKRTVKLDGAHVVYLKRKFHFWKSRDIPDAIKTGCFTQDARGRWYVCFQCEVADDLPTGNGEVGIDLGLKTLATCSNGDTISALRHYRKYEATLAIAQRAGHKQRVRAIHAKIANVRKDQLHKASSKIAAENQLIVVGNVSAAQLAKTRMAKSVLDASWSMLRNMLEYKASRHRARYVEADERWTSQVCSCCGTIPDSSPKGMGALGIRHWVCSDCGCSHDRDANAARNILRVGAERRPPVEEIPAL

SEQ ID NO: 2515 - protein, 367 aa, Unknown
  Description of Unknown: uncultivated organism sequence
  Category: MG81 effectors
  Description: MG81-798 effector
MIVRELKLKLTSNQVSKLNTQLFYLTGVYNWAVRTIELNAVNKIYYSKFDFVNLLANHSKTLGIPSHTLQGILEQAFIAWQRCFKKLAKKPRLKSVRNKLNSIPFPDAISGTRITDKTIGIPGLGQVRFYKQDLPKGKVKCARAVRRASGWYLQLSIDAQHHFPIKETFDKVGIDTGFKHLAVLSNGTKFENQRNFIKGQKRLAQAQRGSNKKLVARLHERTKNRRKDYNHKISRQIVEAFQEIYITNDNLQSQSKMFGKSVHDAGINQLKQFILYKGDTHGRKCVLVDSKNTTMTCSNCGILSGPTGLIGLVVRNWECSACGAQHDRDINAAKVILNTGLGWSLENTETHAVKPEIFRLESSGGAR

SEQ ID NO: 2516 - protein, 536 aa, Unknown
  Description of Unknown: uncultivated organism sequence
  Category: MG81 effectors
  Description: MG81-799 effector
MIDEEYSKILKQYHKLSDRHILAAKTDMPYSDVLKVVALSDKIRKAGNELVGLMRKNYDQLLRTKRYRKLLSLYGGTEDKAKRKNYANQLNEMQKSYNVTWDYCRTSMIPIGKKYGIDAVFALTKAEDVWCGIEKCLYGNGNIIHFSKYGELPCIRAKQINRGIPMSVKDDKLQFKLSKTSFGIQINDRFQQDEVNVILSYLAEPEIMDNKAVNTLIEDACCIDTYRPCYATLVPKMIRGKYRVYLHLTIEGKAKPKYDKHGNLRHKYGKGMIGADVGTQTVAYTSDTEVGLKNLSERGRSIQYSERKERLLFRAMDRSRRATNPQNYNDDGTIKKGHKVWKRSNHYKKLKARYSELCRINAVNRQLAINEDANHLRSLGDTFITEPKNAGRLMKRAKEATKNDKDRFNKKKRFGKSIKNRCPSGFQTTVEKKFKVTGGTYIEVPSNYRASQYDHTADDYIKKKLSDRLYKLRDGTEVQRDWYSSFLLYCYDYRTKDIDKDKCITKFNGCYNKEKALITWIKAHKIKVLNSGIKIA

SEQ ID NO: 2517 - protein, 367 aa, Unknown
  Description of Unknown: uncultivated organism sequence
  Category: MG81 effectors
  Description: MG81-800 effector
MYQVLKLRIYRKHYVKLDKLSSAVNFVWNYVNNLCWQMWRRKRIFPSAYDIHEYTKGAGEELGLHSQTIQFIGEKHYQSRKQHKKVKLAWRTNRPDAKRKSLGWIPFKASAISHVKTYNTGKKALKSQVQLSCGKEKLILTVYDQYDLRRYNGFRTAEIVQDSCDDWYLCLLVKVEPKVCTATGEVGIDYGCKTAATCSNGDKLETKLTKQYAEKLATAQRAHKKNQAKRINRKIKNKRADATHKFTSKLVKENRLIVAGNVKSSSFTSGKLAKSVYDANWFAINRQLEYKSRRAGCQFIVVDEKFSTQTCANCLQITNSSPKGVTGLGIREWICDCCGQLNDRDVNAARNILRFGRETLAEGSPVF

SEQ ID NO: 2518 - protein, 495 aa, Unknown
  Description of Unknown: uncultivated organism sequence
  Category: MG81 effectors
  Description: MG81-801 effector
MSHLRPSRSRNGSPRGIEAGGVIAHNRIEARRQPQQPLQIANFSDLAGVPERAGMMPSPTVTNSRMDETETTDPMDVCNAVDSAALACEGDSTGTWVTRTLRLKVKKNSYAWLNAAAAEVNQVWNWAAEISTKAARPCTGNAKWLTGFDLDKLSSGASKYFHKIGADTIQRVNGEYALKRKAAGRLRLRWRASAGSRRALGWVPFKAESLKRKGRAVRFCGKQIRVFEWKRLEGVKWKQGCFAQDAVGDWWLCLPHALRIEESVAPLEKVGVDLGLKDVAATSDGMRCEKGLFFRGIEKKIAQAQRRGHKRQAKRLHRTASNRRRAALHRFSRRIVENYQKIVVGDVSSTQLVKTRMAKSVLDSGWAMLKTMLQSKGQQAGRIVQIASERYTSSSCSSCGSLSGPHGVNGLRVSHHGTTGSRLRSAVDYAVGRERTVAQSHIRMGAGDEEITIYRFGCPCRNDCSGDSGTRGRSAQPGHDPQSAGVGPPAHRQAG

SEQ ID NO: 2519 - protein, 363 aa, Unknown
  Description of Unknown: uncultivated organism sequence
  Category: MG81 effectors
  Description: MG81-802 effector
MLQVQLKLRPCKAQEQIYDQWLYNLASVYNFAVRKIELNAKDKIYFSKNDFQNLLANHGEKLGIPSHTIQGVLCTVHDAWKRCFKKTAGKPKLKGMRNKMSSIPFPDPIKAPKGNRITLPGLGSVRFHKQEISEGKIKCGRLIKRASGWYLCLFIDAEPNPIKRLAFGAIGIDPGFSNLLTTSDGEVIEHPRELEAAAERLGQAQRGHNKQLAARIQERIANRKKDRNHKLTTKLVSENVLIVWSKDAIKGIAKRFGKSVNSSSHAQIRQMLSYKMPKSGGTFIEVASKYSTKTCNECGNPTGPTGLAGLSVRQWECNVCGAQHDRERRYQHPCCCGRMCRRGLRLCVAVQESQTSSLGASKH

SEQ ID NO: 2520 - protein, 503 aa, Unknown
  Description of Unknown: uncultivated organism sequence
  Category: MG81 effectors
  Description: MG81-803 effector
MAKCKTATCSLTLPLRVEKWQIDKLDKRFEIARKIYNIFVGFELKKLNRLKQTPEYREILHEIKLKNQDKEKNKAEIKALYNKRNAILKQWNFTELRFTNDMTTMNKYYSSNFGAITSQSISNDAWRAFNTLLFGKGEQIKFKKIGAVNSVSGKSFNREIRLIPSKNCIEWKGLTLPYRVERGNLYEEKMLSHKVKYVRILRKWANTKYNYYAQIVLEGVPEPKINKKTGELLHPIGEGRVGLDIGPQTIAYVSDTEVGLTELADKVVSIEKEKRRLSRKLDRSKRATNPTNYNQDGITKHGVKLTHNKSKRYLITQEELKTLYRKQADIRKLQHNILTNKLLSLGSEFYVEKMSIIGLARRAKKTEISEKTGKFKRKRRYGKSITNKAPAMLLQILNNKLKAQSLSKLIEIDTYNAKASQFDHINETYTKKSLSQRWTKLDNGDEIQRDLYSAFLIQNTDNTLKAFDKVLLNEKYSNFKIMHDAFINQLKEQSTYHPTSMGV

SEQ ID NO: 2521 - protein, 348 aa, Unknown
  Description of Unknown: uncultivated organism sequence
  Category: MG81 effectors
  Description: MG81-804 effector
MQLTYRFRLRDKHCSELNRQSRAVNFVWNYCNETQRNAARSSKKWLSGYDLMKLTAGTSGDLGLHGHTIQKTCAQYDKSRRQHKKPWLRFRGKKSLGWVPFNTGQVAFDGASFAFRGVRYEPMHLRDLAPGVKIGIGSFSADSRGRWYINVLVEVPGAAVVPASAVGIDLGLKSLAVLSNGEAIESPRFYRNHEAALATLQKAHKAKRTTAIHAKVANRRKDFLHKASATIARENGLIVVGDVSPSKIAKSRFAKSSLDASWADFKRMLSYKAIRHGGTFLEVDEAYSSQTCSTCGSRPESRPKGIAGLGIREWTCSDCGAVHDRDVNAALNILRAGQRTLAGGAHAA

SEQ ID NO: 2522 - protein, 364 aa, Unknown
  Description of Unknown: uncultivated organism sequence
  Category: MG81 effectors
  Description: MG81-805 effector
MKTQTKTLKVRIKDKHADVLNRMAFECNQVWNAANETSAEFSWVPVPEVGYMNMQTSGFDLMKELKGIRNDRDMIIGAGTVQEVIAVHAKARKQFKKNKLRWRSSGGARRALGWVPFKSGAAVWVNGQIRFCGIHFKCWDSYGLSQYNFRSGSFSQDARGRWYFNIVVQVEVEERIAGNGQIGIDLGLKTTATCSNGDTLERQNCYRNSEAKLGKAQRANKKKQIQTIHAKIKNRRADAIHKFSNKLVKENSLIVVGNVSASGLAKTKMAKSVLDAGWAMLKIQLDYKSKGMQGVFIEVNEAYSTQACSCCGTISANSPKGRAGLGIREWSCPDCGTTHDRDINAAKNILRLGHQSLAVGIPVL

SEQ ID NO: 2523 - protein, 514 aa, Unknown
  Description of Unknown: uncultivated organism sequence
  Category: MG81 effectors
  Description: MG81-806 effector
MGNSSTDTCCLTLPLKLEKWQEDRLAKRFELARQIYNTLVRAELKKLERVKHSAPYREIQGQIQALDWSNPNDKGALRRLYKARDALLKSSGFTEYSFKSDIKYYYKHFSDNIGSDVAFHGIAPQVWTAFEKVLFKGGKKIHYKQYGDVSSVQGYSKTRKSGGREIMFRGTYIEWKGLKLPLKLSPDNAYENEMLRYRVKYVRLVRKPGKQKDRWYAQLALEGKPVVKREPVTGEAVHPVGSGVVGLDIGPQTLAYSAPGEAGLVELAAQVQNIEQAKCRLQRKLDRSRRATNPDNYSEDGTIRRGVKLTRNKSKRYRKIQNQLKYLQYCQAETRKRQHTQLANHLLSLGDSFYVEDMPWPALARRAKETVVSEKTGRIKRKKRFGKSIANKAPATLTHILKQKCTSLGLPGVVEMPTSVRTSQYNHQTGEYIKKPLSQRWNNMPDGQRIQRDLYSAFLLQHYDPGTGTFDSASLQRDYPQFTQYHHQVIQHLLSMPKTPSSMGIRQSVRQYEF

SEQ ID NO: 2524 - protein, 348 aa, Unknown
  Description of Unknown: uncultivated organism sequence
  Category: MG81 effectors
  Description: MG81-807 effector
MIYRHLKLKLTKVQEESVHRWIPSLTSIWNWAICKIENDSKGGIYYSQKEFQNILCGTSKVLNIPSHTVQGVLISAHMAWQMCYKKAAKKPRFKGNRNRLNSIPFPDPFRVPKDNRITVPGLGRVRYHKQDIPEGKIKCGRVVKRASGWYLCLFIDAEPAKISGTGEGAVGIDPGYKHLLTLSTGEKVAHPKELQHSIKRIGQAQRGGNKRLVARLNERIANQRKDRNHKLSHRLVAENAVIAFSKDNIKGLSRAGFGKSVAAAGHGQFRLMLAYKSRAGGRQYIEVPSKGSTRTCSTCGASTGPQGRAGLSVRQWTCSACGTPHDRDVNAAINTLNAALGMSVERAI

SEQ ID NO: 2525 - protein, 387 aa, Unknown
  Description of Unknown: uncultivated organism sequence
  Category: MG81 effectors
  Description: MG81-808 effector
MKTLKLRIKDKHATQLNRLSSSVNFVWNYVNDLGYKYLQRTGKFLSAYDLNDYTKGSGELLGLYSQTIQAINETHAKSRKQFKKAKLNWRTNNPNSKRKSLGWIPFKQSAIKHIATHQTGKKGLKSTLQLSLDKGKKLVIDLWDSYNLSLYQINTCELVQDSRNRWYACITVKNYLKQTCGTGSVGIDLGLKDSATTSNGDKLQIKQTLKYAKDLAIAQRAKNKQRVKAIHAKIKNTRLDLIHKFTTGLIKQNALIVVGDVKSNQFNSKKGKLAKSVYDAGWFELKRQLDYKCKYAGCQLEMVNESYTTQTCSCCRQIDSNSPKGRTGLRIREWTCAKCSTWHDRDINAGKNILAVGLDRLGAGIPERQGGEEVKGHAHPSHLYECE

SEQ ID NO: 2526 - protein, 1330 aa, Unknown
  Description of Unknown: uncultivated organism sequence
  Category: MG81 effectors
  Description: MG81-809 effector
MKREKNITIMKISKVNHRRTAVALNGDKSELGGILYEAPVQKDKNGNYNDVIAETGKVVNEALDKKSRLYTPFNNQKVIIDKNLQRYANNLKRCYINFVKQYVNNKSFNYKAMQFIPDIQNPKTNDAVNYRTDRDNVYNKNKYYDKQTKSKSKKFIYEKIVIPQNEQNIVISALVNCSLRKSLRKDVSYKTKSGEIKTYNLPELVKKSMRFYCLEGQREPDEKEKYEMYILFSYMKEDKRTKNTDLLVKSISNQNTKVKVEDIDGNKLLKLSIADTKKKPLWEYLIKYADSSRQRELMYDIRKKIILYVAGIEEYENIKEDSGLSKVSWSKYNISDNKMFFDINSCTDKRKQNLEIKIREANIEHYRNASSKLCDDESIFWFQHFEGVIETLFSKKSKISEERLGCAYICDYLWKDFLSYLAAKYIDLGKGVYHFTMKDKLDMLNKNEAITDLRFGIVSEKYEKGITSFDYERIKAEEELDRNIAAYVTFAADIFAKSVIKSDYRTKKDNNSDVLQYSDKEFRNSEVIRDNAEKNILQYWGGYSRWGTENSKLPENNKVSDFDKLDVSDLCIDIKKHLAGIRNSSVHYTTKIKNESAADGSNVKILFEKDLADINIIYADKYYSNNVWMFYSLEDINKLIAFLYKEKRVIRQVQIPSFSRILKRKAMQDVINEIFKDDFDENIVNPELKEKYRNSLYFMLKEIYYNAFIIQPELKEKFKDKIKTMKSELYNKLKTIDKKEYKALYCMLSNEESALKNFADRIYSVDGDNVSFADICKILMTDYNMQNQEKKNIESMEQKKKNKGKDENYKHFPLLLHKVLKELFIEYLKQTHELEFLRNNICIKSDVTMESFESQIKGVEIYKDLKEKIDKNNSLLDWYVIAHFLMPKQLNHLIGNIKNYIQFATNIDKRAESVKNLTESGMVKRIQYYDDIVRTLEFSAQYIGKISNNINDYFNSEDEYVSFLSKYVGFINDKSEDVLTELKDFCREKINNGSQIIGIYYGGDNVIINRNVIYAQMYSNAEVFSNIYKKVTKNDIINYYEKQNDLKDVFKSGVCQNEDEQRSLCEFQQLKNRIELTELSTYADMVNDFMAQFVEWAYLRERDLMYFQLGIHYIRLFYSDNVLDEKYHKLSDNVIDIEEGALLYQIVAMYDYELRIFETDNSGNAKRIGQGGPGKSIPVFLKKYCNGTDVYECGLELFEDINQHEHIIRFRNDIAHMRYMSNQAMNIMSIVSNIYKSFFAYDTKLKKSISLVFKNILMRYGVIADLVFSYNNKNQSIKDDMDINIINIKNLKSDKYVYKIVNEDIVKQVEIEIRNQVFLEQLHNLLYFSR

SEQ ID NO: 2527 - protein, 370 aa, Unknown
  Description of Unknown: uncultivated organism sequence
  Category: MG81 effectors
  Description: MG81-810 effector
MYITYRYRVKSLEGLLRKQAQAVNYVWNYCNETQKSYLRLGKKWLNHFDLTKLTTGVSKELGINSDTIGAICKKYVLSRRQHKRPFLRWRTKKSLGWIPLRGRHLEQTPNGFKYGGKIFKVFLSRPIPPVAKICDGSSFSEDARGRWYINLLLKLPDETVRPVQTAVGIDLGLKDLAVLSNGEKVETPKFFRGLEEKLGKAQRAKKKRLEKSIHAKISNSRKDFLHKLSTRIVKRFDWIAVGNVSSSKLAKTRMAKSVLDAGWSSFRSFLAYKALACGATFMEVNESFSTQVCSSCGCIPPESPKGIADLGIRNWTCGDCGAVHDRDVNSANNILFGSGCRTPVEGTLIENMKETSNPDLSKCEKVFTFK

SEQ ID NO: 2528 - protein, 578 aa, Unknown
  Description of Unknown: uncultivated organism sequence
  Category: MG81 effectors
  Description: MG81-811 effector
MAFGSKNSTPSFVLTLPMVIGLNEQDYLNKEFKKCGIIYNQLVNATTKMWHQLRKTRKYRELMAAIAKAAPDSDEQKALFKQREKMLKEYRFSEDAFHAMVVPYAKHYAINSHVAQSIATAVWTAWSSFFFDKGKGVHYKKLEYVSSISGKNNATGIMLRPANHTTSVINSAKTKAKNSIEKKYFAAYRKPDAKEGEEVVLPDEVKAQMEKEIAAATAKVKTSIGKGKLHITYGDYTFPVTLRNPDTQTGWYQQEALKCGVKYCRIIRKWVSTKWKYYAQIVLEGYPPIKCDNNGVAKHPVKQGRVGIDIGTQTIAFSGKDVCDLRVLAPAARAQAKSLVNEIASTLRAMDRSRRATNPKYYNPDGTIKRLKRQHGQKQKRKWKYSKRYYRLRAKLRNLYRKLADIRKMEHNILANELLANGNEFVVEDMNYKALQKRSKETKINPKTGRAYTKKRFGKSLSRCAPAMFISILGKKANRYGGSVIKVSTFETKASQFDHTDESYTKKKLSERMARLRSGDIVQRDLYSAFLLEHIDTESLQYNMETLNSAFPAFLEMHENTKRRLQTVGSSLPASIGF

SEQ ID NO: 2529 - protein, 383 aa, Unknown
  Description of Unknown: uncultivated organism sequence
  Category: MG81 effectors
  Description: MG81-812 effector
MPLSFTRTLRLKVRREAYAWLNAAAVEVNEVFNYCNETSLKAATRTDNKRKWMSGFDLCYLTAGATQYFDRIGAGTIQSICIHYAQKRQAARRVKLRWRVSRGARRSLGWVPFKAASLKRKGVCLRFAGKCLRVFERERLEGVRWQAGCFAQDAVGDWWLCLPVKVEAEETIAPQEAVGIDLGLKEIAVTSGGERLEAGRWTQGYAQKLASAQRRGHKRQAKRIHRKAARCRADALHKFSRRIVDRYQNIIVGDVSSLKLVKTRMAKSVLDSGWGMLKNFLDYKSQQAARSFKVVSERNTSVTCSACGALTGPRGVNGLIVRLWICSDCGESHDRDVNAARNILIGSRCRTSVSGNESSPWLIPPSSAYRVREAGIETARAAA

SEQ ID NO: 2530 - protein, 347 aa, Unknown
  Description of Unknown: uncultivated organism sequence
  Category: MG81 effectors
  Description: MG81-813 effector
MIQYQLKLRMCKSQEQQCEQFLYHLSSVWNWAVRKIELNAKDHIYFSKMEFQNFLANHSERIGIPSHTLQGVICTAHDAWKRCFKKIGGKPRLKGMRNKMSSIPFPDPIKAPKGNRIILPALGSVRFHKMDLPTGKIKCGRVVKRSSGWHLCLFIDAEPKAIERMGYGVIGIDGGFKDLLTLSTGEKIEHPRELEAAAERLAQAQRGHDTKLAARIQERIANQRKDRNHKLSHRLVAENVVIKFSADNHKAVARRFGKSVASSGHSQLQRMLSYKSPQSGTEYFEIAPKDSTKTCWVCGEPTGPTGLAGLSVRQWRCTTCGTFHDRDQNAAVNTLIAAAGCAVEVCI

SEQ ID NO: 2531 - protein, 352 aa, Unknown
  Description of Unknown: uncultivated organism sequence
  Category: MG81 effectors
  Description: MG81-814 effector
MTQTKTLKVRIRDKHAPMLRHMARSVNFVWNYLNELSQRSIRERGVFLSAYDMQKYTNGCAKELGLHSHTVQVVGKEYATRRLQFRKSRLNWRKSRGVRRSLGWIPLNTGAASWKNGQVYHNGNFFKVWDSFGLGHYRFRSGSFTEDARGRWYFNVVVDVEAKPSAGKHAVGIDLGLKTVATCSDGAALENARFYRDLEPALAIAQRAGKKARVRTIHAKIANRRKDALHKFSRSLVERCNLIVVGDVSPQKLAKTNMAKSVLDAGWGQLKTMLAYKCAHAGIVFREVSEAYTTQTCSCCGAMPGERPRGIAGLGIREWTWECGVTHDRDINAARNILAAGHRRLAVGIPAL

SEQ ID NO: 2532 - protein, 1668 aa, Unknown
  Description of Unknown: uncultivated organism sequence
  Category: MG81 effectors
  Description: MG81-815 effector
MDLHSDGDGERDHGIISPVKEKVEETLPEFICKGTYKGVPLCDDNKNRIRGRKGKYHLFVLLKSDAGKKHLLAENANMLVKDDWAANRYFHMASSVVNRLIFHNPLYSGGQMPAIKLDIATRATGDIDKMGNGIKEEFQKQKYRVKKGNNREYYSIMNADIYRTLIAQEMVNSGKINIRIEKLNIKSICYDSSGQGMEFLYLADSICSILGYRLTKTGSSADDWLVQIKERICDLNRDNENLIFGYDEIDNYFSNAWGQFENKDMFKALSVIYDAKWMKGEFAKHYQNEWFPFLEEQLRRRATPELFLQSVDQLHAFLQTNNIDQEKLLYIMQQLESMVEGVSNRFKSKESKERALYKLYDAGVAVYCHIGDATKAQGYYEKCRLHVVYVSLDDYMKTNNRLIVLLEDAFQWDEALNKAKENLDILQMIAKGATVSPKNFLDCLQKSAETIKFERRKKKSGNVVWVPVKLEEDYKKYGTSLQEQVEQAVHFNIKRSLSKETVIHSVCKILISFFQKNQITLKEEESRLLIQALDKDIRKEKQLKYIEKSIQLQNTKVQPVQVDGKTVLALSGAKHPKKKIIFDFLVRYANASQSDQENMLIQMRKWILLFVCGEQAYKEAEEKGISTRGFAAEHGDIPGTFGGDVYSKISDLQEIKKQDKGASERLKVSKLKKEIAAMINDTLTTVYREIKGMDGVAEEDMFWIEYIQKEVQKVLLKKNKLATGIEYKIQNKYLCNQVWKNWVSFIAGKYVDMGKGVYHFVMPECNSNINELEVCEVQDFYKKGISSFDYEMIKAEETLERDMAVAVTFAVNNFSRAIIKKESERTTSQNEDVLQYTEKEFEKYCDGENIHKNILQYFGGISKWEDCEIVHASGFEVFDTIKKNINCVRNASYHYSQNLEKREVRNKYVDMLCRHEVDNYTEIIKDKYYSNNLYRFYPESTLKRLMDELYSEVKERPAQIPAFNRIINKQKIAAFLSTVIKGNKLKKVIGNVEDASLFYPAMIFLLKEIYYNAFICNENCKKWVEEAALKNAENEKDKNKKEANKNFILRLEQLHTESFGDMCQQLMTALDLQNNRDHRVNTNADQLKYKHFRILLYNAIYEAFANFIKSKEQKLYSLYDAVREPVLQTNLKTREEFLSGWTAHRYDTKIDKITGNSILSAWYVTSHFLAPRQVNHLAGSMKNYRQFVNDIGDRRNKVESKQSYRKTEIYEDVVMVLELVDASSGQISNEVKDYFGSDEEYARHLSKYVDFSDEKAKNNMEEPSCRMLLQLFSENRQQTGDGDMIDIYYKNNVILNRNIVLSKMYGLDICENGWWQKVTLENDILNYYKLKRELSSGSKFTGTAVFEKGRCEFPEEQEKLKKFQNIKNRVELLDVMTYEEILIDLYSQLVSWAYMRERDLLYMQLGVAYLALNYGDKSYRTRSREMFGDDRLNSMEGPGPVNIKNGALLYQLIAMNNPCMTLYEVENGKATPAKKAGNSIGARVGCLYKGYLNCREEVYKNGLYFFENYQLHDYIVKHVRNEIDHFKYFRKPVKSLLELYSEIYTYFFTYDKKLQKSVTFILLNILEKYFVRAKIQMGYKKVEVKNDKKEMIPVIETDINIEKAHSLYMFYNQIKYREQDSKEDKKAYNDYKSRYDLDIGKGVLKLEARDDLFVKQLLELLSYKESMR

SEQ ID NO: 2533 - protein, 353 aa, Unknown
  Description of Unknown: uncultivated organism sequence
  Category: MG81 effectors
  Description: MG81-817 effector
MIQCQVKLKLTPRQGRQLDHWLRHLTSVWNWAIKKIENDGRDGIYYRSKEFQNLLAGHSRKLSIPSHVLQGVLSQAHGAWARCFKRITRRPRLKGRRNKFNSIPFPDPIRPPTGNSLTLFGIRRVRFHKQTIPSGVIKCGRIVKRASGWYLCLFIDAEPNAISPISNGEIGIDPGFSSLLILSTGEKIEHPRELEATEQRLAQAQRGNNKQLVSRLQERISNQRKDRNHKLSHRLVAENQVVAFSKDRHSAIAKRFGKSVASSGHYQLRQMLSYKSKCRTDGLGVYVEVDSRNSTKTCSACGCLSGPTGLAGLKVRQWTCADCGAQHDRDVNAAINTLIAGAGLAHEMSVRAA

SEQ ID NO: 2534 - protein, 352 aa, Unknown
  Description of Unknown: uncultivated organism sequence
  Category: MG81 effectors
  Description: MG81-818 effector
MIQIQLKLRPTPRQERRLGHWLRHLGSVWNWAIKKIEHDSRDCIYYSSLDFRNLLNSHGPKMDVAQDAICGTLWSAHTSWRRCFKKVSRKPRLKGRRNRFNSIPFAHGVKVIDGRLSVVRLGRIRFHKQEIPEGQISQFRLVKRASGWYACLFIKADGDAIFATADGCVGIDPGFSSLLTLSDGEVVEHPRELEASAKRLSQSQRGRNRKFTSRLQERIANQRKDRNHKLSRRLIAENQLIAFSADRHKSIAKRFGKSVASSGHAQLRQMLSYKSKRRTDGLGVYVEVDSRNSTKTCSACGCLSGPTGLAGLKVREWECAQCGTEHDRDINAAINTLIVGLGGSHERQAIAI

SEQ ID NO: 2535 - protein, 352 aa, Unknown
  Description of Unknown: uncultivated organism sequence
  Category: MG81 effectors
  Description: MG81-819 effector
MKTLKLRIKDKHCKVLDQLASEVNFVWNYVNDLCFKHLQRKQQFFSAYDIAKYTKGTSKECNLHSQTIQAVAEELVTRRKQFKKAKLKWRVSNKKNARRSLGWIPFKKVAVKYADGYVQYGKHQFKLWDSYGLSKYNVKTGSFVEDSRGRWYVCLVVDSIKTEKTTAKTSIGIDLGLKDLATCSDGVKFKAPKIYRQYEQKLGIAQRARNKKRVKAIHAKIKNLRQNMLHQFSHKLVNEHAAIFVGNVNAKALAQTKLAKSVLDAGWTTLRTMLKYKCENAGVWYEEVNEAYTTQTCSCCGSRSSSLKGRAGLGIREWQCVECGTFHDRDINSALNILALGHGRLAGGISVL

SEQ ID NO: 2536 - protein, 491 aa, Unknown
  Description of Unknown: uncultivated organism sequence
  Category: MG81 effectors
  Description: MG81-820 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGERRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVVKVPTSLRASQYNHQSGEYTSKPLSQRWNNMPDGERIQRDLYSAFLLQHYDPKAGSFDSALLQQDYPQFVQYHHRAI

SEQ ID NO: 2537 - protein, 367 aa, Unknown
  Description of Unknown: uncultivated organism sequence
  Category: MG81 effectors
  Description: MG81-821 effector
MKTLKLRIKDKHANQLNKLAGSVNYAWNYVNDVSYKHLQKTGKFFSAYDLNEYTKGSGEYLGLHSQTLQAINETHAKSRKQFKKAKLNWRTNRPDAKRKSLGWIPFKKSAIKYLSTRQTGKKALKSTIQLSLSKGQKLIIDVFDSYNLSLYQINTLEIVQDSRNRWYACITVKDFPRQVSGKGSVGIDLGLKESATTSMGDVLTTKQTQKWAKKLAVAQRANNKKWVKAIHAKIKNSRLDLIHKFTTQLIKDNALIVVGYVKSRSFTGKKTKLAKSTYDAGWYELKRQLKYKCENAGCRFEIVNEKYTTQTCSCCGDMSSSPKGRAGLRIRGWTCAECGTWHDRDINAAKNILAVGLDRLAGGIATQ

SEQ ID NO: 2538 - protein, 352 aa, Unknown
  Description of Unknown: uncultivated organism sequence
  Category: MG81 effectors
  Description: MG81-822 effector
MIQCQLKLKLTARQERQLGHWLRHLTSVWNWAVKKIENDARNGIYYSRLTFRNLLNGHGRKIDVPQDALCGTLDTAYTAWRRCFKKQTRRPRLKGRRNRLNSIAFGHGTRVINGRVVIPRMGRVRFYKQAIPMGHIGQFRLVKRASGWYACLFIQADREAVPVVASGTVGIDPGFSSLLTLSTGEKVEHPRELEASTLRLAQAQRGSNKKLAARIQERISNQRKDRNHKLSRRLVAENQLIAFSADRHKSIAKRFGKSVASSGHAQLRQMLSYKSKCRTDGLGVYVEVDSRNSTKTCSACGCLSGPTGLAGLKVRQWVCVACGAEHDRDINAAVNTLIAGAGAVHEGQVIAA

SEQ ID NO: 2539 - protein, 344 aa, Unknown
  Description of Unknown: uncultivated organism sequence
  Category: MG81 effectors
  Description: MG81-823 effector
MARAVNYVWNYCNDIQKKAARSNRRWVNWVMLNNLTSGCSKELRLHSQTIQAIGECYATSLKEAKSPTGKKKRFLRFRGRRSQGWIPFKASGIKLRGDSAVYQGRRFKFWKTRDIPPTIKNGNFSCDSRGRWYLNLVCEYEETIVSNEGNVGIDLGLKSLATLSTGKKYDAQKFFRKYERKLAHHQRCNNSRQVQTIHAKIANSRKDFNHKVSHELTRDFNKIFVGDVGSLGLLKTKLAKSVSDASWGQLRTFIEYKAIARGGTYYVVDENNTTRTCSACGCLTGPSGLAGLRVREWQCKECGTVHDRDTNSAINIEQRGLLTLPSPLRTLSAKDSESLGIPRL

SEQ ID NO: 2540 - protein, 351 aa, Unknown
  Description of Unknown: uncultivated organism sequence
  Category: MG81 effectors
  Description: MG81-824 effector
MIQTQLKLRLSATKEAQLNDWLWSLTGIHNFAVRKIELDAKDGIFYPRMGFQNILAGHGGKIGIPSHVVQGMLAQVHTAWSRCFKKIGGKPKLKSARNKLNSIPFPDPIRSPNGNHIKLPGIGLICFHKQEIPVGDIKCGRIVKRASGWYLCLFIDAERKPIKRIACGRIGIDPGFKDLITTSDGEKVPHPKELQNKIARIGKAQRGVNRKLVARLHERVSNQRKDRNHKLSLRLVQENTLIVFSKDNIKGIAKKFGKSVSSSGHAQLRSMLNYKSRAGGSQYTEVNPRNSTRTCSSCGALTGPHGLAGLSVRQWECGCGVRHDRDVNAAVNTLLSGLECAANQGGLRDVA

SEQ ID NO: 2541 - protein, 348 aa, Unknown
  Description of Unknown: uncultivated organism sequence
  Category: MG81 effectors
  Description: MG81-826 effector
MQITLKLRLRDRHAAKLARHARAVNYVWNYCNERQRQAVRECRRWLSYPALAALTAGTSVDLDLHAHTIQRVCLAYAAARRAHKKPWLRWRGRRSLGWVPFNTGHVSFDGEAFTFRGVRYETMHLREIPTGAVIGAGSFNADARGRWYINLPVEVLEATSASITHVGIDLGLKDFATLSTGEKIAAPRFYRASETKLATAQRARKTRHARAIHRKIAARRRDFLHKTSVQLVKRFGLIFVGDINPSQLVRTTMAKSVLDAGWSNFRAMLRYKSRLRGGGVCLEVSEHLSTQTCSECGRLPASRPRGIAGLRERVWRCDDCGTVHDRDVNAARNILRLGQQTLGGGAHV

SEQ ID NO: 2542 - protein, 384 aa, Unknown
  Description of Unknown: uncultivated organism sequence
  Category: MG81 effectors
  Description: MG81-827 effector
MTGVFGTIFATSNFMARPSKSANRQAALGVTTRVLRLRIKDKHARVLSAMAREVNQVWNYCNETSHRAIRERSQWLSGYDLQKLTNGFSKCEGVQIGSPTVQQVCEDYAKARKQFKRAKLRWRVSNPKSSKYSLGWIPFKARALQYKAGQIAFAGQRLHLWDSYGLGDYELRAGSFSEDSRGRWYLNVVVKVSTKASTATASVGIDLGLKEAAVASDAQRIEGRFYRKLEARLGIAQRAGKKCRVKAIHAKIKNQRKDMLHKFSAAMVKDYGAIFVGDVASAKLVKTKMAKSTLDAGWASLKTMLEYKSHQAGVVFEVVSESYTTQTCSCCGSIPASSPKGRTGLRIREWVCSGCGAVHDRDVNAARNILAAGHRRLAEGISGV

SEQ ID NO: 2543 - protein, 536 aa, Unknown
  Description of Unknown: uncultivated organism sequence
  Category: MG81 effectors
  Description: MG81-828 effector
MIDGEYKKILKQYHKLSGRHILVAETDMPYSDVLKIVILSDKIRKAGNELVGLMRKNYDQLFRTKRYRKLLFLYGNTGDKVKRKILANQLNEMQKSYNVTWDYCRKSMIPIGKKYGVDAVFALTKAEDVWHGVEKCLYGNGRTIHFSKYGELPCIRAKQINRGIPISVKDNRLQFKLGKTTFGIQADDRFQTDEVNAVLAYLAEPEIMDKKAVNTLIEDAYCVDTYRPCYATLVPKMIRGKYRVYLHLTIEGKAKPKYDKYGNLRHKYGKGMIGADIGTQTIAYTSNIEVGLKNLSERGNSIQTSERKERLLYRAMDRSRKATNPQNYNDDGTVKKGHKTWKYSNHYKKLRARHSELCRINAVNRNLAIKEDVNHLRSLGDVFVTEPKNASKLMKRAIKTTKNYKGRFNRKKRFGKSIKNRCPGGFQSNVEKKFKATGGTYIEVPNNYRASQYDHTADDYIKKKLSDRLFKLHDGTEVQRDWYSSFLLYCYDHMTHDIDKNKCNTKFEEQYNREKALITWIKANKLKILNSGIKIA

SEQ ID NO: 2544 - protein, 356 aa, Unknown
  Description of Unknown: uncultivated organism sequence
  Category: MG81 effectors
  Description: MG81-829 effector
METTKTLKLRIKDKHARVLSAMAREVNTVWNFCNETSHRSIRERFKWLSAYDLQKLTAGYSKCEGVQIGSATAQLVCEEYALRRRQFKKAKLRWRVSNPKSSKYSLGWIPFKVGGVKYKAGQVVFAGHKLSLWDSYGLADYELRAGSFVQDTRGRWYLCVAVKVQVKPSTATGSIGLDLGLKEAAVASDGQRIEGRFYRKLEAKLGIAQRAHKKQRVKALHAKIANQRKDMLHKFSTRLTKEYGAIFVGDVSSQKLVKTKMAKSTLDAGWSMLKTMLEYKSQQAGVVFEVVNESYTTQTCSCCGSIPASSPKGRAGLRIREWTCSDCGAVHNRDTNAARNILAAGLRRLEAGITVL

SEQ ID NO: 2545 - protein, 420 aa, Unknown
  Description of Unknown: uncultivated organism sequence
  Category: MG81 effectors
  Description: MG81-830 effector
MVSETGLEPAPHAPNARALPTELLTEKMVCVNGFEPLISCFRGKWSNQTLLYAVINKLLQLCVILTPYMKTLKLRLKDKHASVLIAMAKEVNTVWNFCNETSHKAIVERKKFLTSYDLDKLTAGYTKIDGVKINSRVMQSVSVEYVSRRKQFKKNKLAWRVSNGKASKRSLGWIPFKVDTIVYKSGQVKFAGYKFSLWDSYGLSQYKFRSGSFNQDARGRWYLNIAVEIEPFVGPQPQKSQIGIDLGLKSAVTCSDGKVLIGRNYRKYEKAIALSQRARTKKKTRNIHAKIKNTRKDELHKLSNELVRKNSMIFVGNVNGSKLAKTKMAKSTYDAGWYMFKTMLEYKCNYAGAVFEVVDESYTTQTCSTCLRLSGPQNLKGLGMREWICCGCQSVHDRDINSAQNILAVGLGRLAEGIAV

SEQ ID NO: 2546 - protein, 389 aa, Unknown
  Description of Unknown: uncultivated organism sequence
  Category: MG81 effectors
  Description: MG81-831 effector
MNNPLMPLSFTRTLRLKVRREAYPWLTRAAFETNQVFNYCNEASLLAATRTDLKRKWLTGFDLCNLTSGATKYFEHIGADTVQSICVHFAQKRIAAKKLKLRWRASGGAKRALGWIPFKAASVKRKGNSLRFAGKMFRVFNRDYLGEHKFRDGCFAQDACGDWYLCIPVHMPVEQTVAPREEVGIDLGVKTIATTSDGEKLEGGRWTHGGADKLAMAQRRGHKKQAKRIHRRVANQRKDALHKFSRKIVDQYQNIIVGDVSSKKLVKTKMAKSVLDSGWGMLKNMLDYKSQQAARTFSVVNESYTSITCSSCGSLTGPRGVNGLIVRSWICSECGDSHDRDVNAARNILTAARLSPSVRGNESSDSLIPSSRLRKHRRETRTESVRTAA

SEQ ID NO: 2547 - protein, 511 aa, Unknown
  Description of Unknown: uncultivated organism sequence
  Category: MG81 effectors
  Description: MG81-832 effector
MSKRNTTDTCCLTLPLKLEKWQEDRLSKRFEIARQIYNTLVHAELKKLRQVEQSAEYRQIQVQLREMYQNNTTKTKEFRDIANRRRKLLDAAGFREYDFKSAIKDYYKYFKENIGSNVAIHGIAPLVWTAFENKLYKNGKKVHYKRPGDIYSLRGYSVTGKSGGSEIMFRGTYVEWKGLKLPIKRSPDNDYETAMLEYRVKYVRILRKPGKHKNHWYAQLSLEGKPVIKMNPVSNEPVHPIGSGAVGIDIGPQTIAYASQSEAGLLELASQVQNIERQKGLLQRKMERSRRDMNPENYMPDGTFRRGVKLTKNKSKHYCKLQRELAYLQHRQVETRKRQHIELANHLLSLGDCFYVEDMKWLSLTHRAKETEISEKTGRIKRKKRFGKSIANKAPATLIGILDTKCKSLGIPGVVKVPTIMKASQYNHQSDTYEKKPLGQRWNDMPSGERIQRDLYSAFLLQHLEPDLTGYNKKMLAQDYPQFVEYHNHVINDLSMKPKTLASMGIRRRVS

SEQ ID NO: 2548 - protein, 383 aa, Unknown
  Description of Unknown: uncultivated organism sequence
  Category: MG81 effectors
  Description: MG81-833 effector
MQGEDDVPPGAKLHRPNRLDALCQGRDHPYRPNGSEDLQLPRQGRDERLIALGDAVNTVWNYFNEISMRSAQRGPIWAAKKQLRVLTKGSGKLLGLPSQVVQEMINQYVIKRKAARRPKLRWRASRGPRRALGWVPFTNQDIALDGTTVLLRGQRFRLWLHRAVEGRIKSGNFSQDARGRWYCNLVCEVPRSQGRGRDDIGVDLGLKSVAKCSDGTGLEQAQFYRCLEPKLAEAQRKRRKRQVKSIHAKIANRRKDVLHKFSRALVDRARKITVGDVSASAMTKTRMAKSVLDAGWSTLRGMLRYKCDHAGVAYAEVNEANTTRTCSFCGRLSGPTGLAGLSIRRWTCGECGSEHERDQNAARNIARLGCETPCPSGHGSPGF

SEQ ID NO: 2549 - protein, 579 aa, Unknown
  Description of Unknown: uncultivated organism sequence
  Category: MG81 effectors
  Description: MG81-834 effector
MAFGNKNSTPSFVLTLPMKVTEQDEIFLSKKFRVGCTVYNQMVTKTTKMWHQLRKTREYKNLVKAIKAAPANSDKRKALLVQRSNLIKQAGFSEGAFHKLVVPYQKAYNVNCDVAQKVASAVWKAWDDFFYGKGKTVHYKKLDDFVTLSGKKNNSGIFFRPANHTVSSMKSAKRKAKNSIEKKYFDAYRKPNTKKDKEVVLPDEVKAQMDKEVADATTKAKPCIGEGNLRIIYEKYEFLVKLRNPDIQTGWYQQEALKCGVKYCRIVRSWVGTKWKYYAQLVLEGYPPIKCDSNGVVKHHVKQGRVGIDIGTQTIAFCGKDVCDLRVLAPSAIAEVCNGLTKEIARIMRQMDRSRRAMNPQYFNENGTVKRLKRKNGHKQIRHWNYSKNYYRLLHKLRNLNRKLADVRKMEHYILANELLTYGNEFIVEDMNYKALQKRNKKTKINPKTGRAHSKKRFGKSIGRCAPAMFISILNQKANRYGGSVIKVSTFETKASQFDHTDDSYTKKKLSQRFAKLSDGTVVQRDLYSAFLLLHLRKNLQSYNKKTIKKDFPQFKKLHDETKERLKSSHEWLPTSVGF

SEQ ID NO: 2550 - protein, 381 aa, Unknown
  Description of Unknown: uncultivated organism sequence
  Category: MG81 effectors
  Description: MG81-835 effector
MVSLETPLTTRTVEGGHDMARTKPTKSIIQCQLKLKLRPAQERMLNRWLWHLTAVFNWAYKTVEHNANQGIYLSRYDLESRLAFHSGRMGIPARVLDGAARTAHDAWQRCFQRLARRPRMKGRRNRLNSILFRQVINRVECDRIFVSGFGMVRFHRQEIPAGRITGARLIRRSSGWYFSLFVEASPRSIPVLSSGEIGIDPGFVSLISLSTGEKVEQALELKQTAMRLAQSQRGSDRRLTARLKEREANQRKDRNHKLSRRLLSENALICWSKDSHRAIARTFGKSVASAAHGQLRQMLAYKCRAGGREFIEVPNRYSTMTCSACGARSGPTGYAGLSVRQWTCGCGASWDRDVNAALNTLIAGRGLRLERVGDGSSGIVT

SEQ ID NO: 2551 - protein, 363 aa, Unknown
  Description of Unknown: uncultivated organism sequence
  Category: MG81 effectors
  Description: MG81-836 effector
MSIQTKTLSVRVKDRHAAVLRQMAFEVNQVFNLANEITSEAYSNAGVFGAQVPKWLTAFDVQKMTTGIQRERGYSIGSATVQEVIAHHGKARKQFKRSRLRWRVSGGARRSLGWVPFKSKQAQWQNGCVKFAGHYFKVWDSYGLAGYKFRAGSFSEDSRGRWYFNICVEVATVHTTGATAVGIDLGLKDTATVSDGSKLIAGRFYRDLQPALGKAQQAGKKARVRAIYAKIKNRRKDALHKFSTALVNSHAAIFVGDVSSSKLAKTKMAKSVLDAGWAMLKTQLEYKAIARSVVFEVVNERYSTQACSCCGAISNNSPKGRAGLRIREWTCCECGTAHDRDVNAAKNILAAGHCRLAVGIPVL

SEQ ID NO: 2552 - protein, 538 aa, Unknown
  Description of Unknown: uncultivated organism sequence
  Category: MG81 effectors
  Description: MG81-837 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2553 - protein, 349 aa, Unknown
  Description of Unknown: uncultivated organism sequence
  Category: MG81 effectors
  Description: MG81-838 effector
MSTKVYRYRVKSLNGLLNKQARAVNFVWNFCNDTQKHALKWRKRWPTGFDLNVLTAGSSKELGIHSGTINAVCEQYAKSRKQFKRPYLRYRGKRSLGWVPLKGRDLKRHGDAFRFAGNTFRVFNSRPLPEGKIKDGTCFSQDRRGNWFLNIVVDVADAETRKPVRGVGIDLGLADLATLSNGEKIEHPRCFRQLEEKLAKAQRARKKRLVAKIHAKIANTRMDFLHKASTDIVRRFDYIAVGNVSSGKLAKTKMAKSVYDASWHSFKTMLAYKSVANGAWYKEVNESFSSQACSACGALPESSPKGIAGLRIREWVCSECGAVHDRDVNAALNILRSGRRAPVVGIPAL

SEQ ID NO: 2554 - protein, 512 aa, Unknown
  Description of Unknown: uncultivated organism sequence
  Category: MG81 effectors
  Description: MG81-839 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLEFADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2555 - protein, 495 aa, Unknown
  Description of Unknown: uncultivated organism sequence
  Category: MG81 effectors
  Description: MG81-840 effector
MAGKSDKACCVLTLPLLTEPWQEHIIEKRFRIMEHLKNSLIALELRKLKNIQRTKQYRQLEAEISNAPKENRKTLYKKRNELLKNAGFSEFAFIDDMTNMQKHFVEHIATQIAHKSASDVWSSFEKVLFNTGRKIHFIRRGSLSSIACKKDGNGMRFRNGMLHWNGGQCKNKVKLELRVACPKTPYECAMLEKKIKYERIIRKWVKTRYKYYVQFTLDGNAVPKPRKMGTGRVGIDIGPSSIAIASSQEVRLMELADKINQNHLRKVALQQKMDRSRRATNPDNFNENKTIRRGVKLSWHYSKHYQKLRGQVRELERKNADIRKYQHTCLANYILSLGTEVYIEQMNFKGLQARAKETTYNKNGRANRKKRFGKSIANRAPAMLVTILETKLKSYAGTELHKVNTWSYRASQYDHITDTYTKKLLRQRWAELGNGDRIQRDLYSAFLLMNSQPSLQSTDRERCSKTYSQFKSLHDQEIYRLQQTPERHLSSFGIA

SEQ ID NO: 2556 - protein, 352 aa, Unknown
  Description of Unknown: uncultivated organism sequence
  Category: MG81 effectors
  Description: MG81-841 effector
MILTYKYRIKNRSAKSALRRHAFAVNQVWNYCCAQQRDIESRYRAGAPKRKWASHYDLQRLCKGAGAMFGIHQQTIGGVCRTFAQARDKARHAPAFRKSYGVRRSLGWIPFEGQSRQIKDGAVTYLGKRFYLWGLKRRPIPATVKGGAFVEDALGRWYVCLTVEVERKPATNDKAIGIDLGLKSLATLSDGRKIEAPQIYRRYEQQLATLQRAGKRRHAKRLHAKIKACRADFLHKISTELAGQNAIIAVGNVNARDLASKSVLDAGWSSFRKMLAYKAKDYREVDERFTTQDCSACGARCGPKGQKGLGIRQWQCSSCGISHDRDVNAALNILAIARRSAAPPAEEYRRAA

SEQ ID NO: 2557 - protein, 350 aa, Unknown
  Description of Unknown: uncultivated organism sequence
  Category: MG81 effectors
  Description: MG81-842 effector
MITYTLKLRLNTKQEATLNTWLFNLTGVWNWSIKKIEHNAQDKIYFSAFDFVNLLSDHGKKLGIPSHTIQGVLSQAYTAWSRCFKKIGGKPKLKGQRNKLNSVVFPDRIHPPKENHISIPGIGKIRYHKQMLPKGNIKCGRIIKRASGWYLCLFIDAERAAIIRTGYGKIGIDPGFKSLLTLSTGEKIEHPRELEAVEKRLGQAQRGHDKQLAARLSERRANQAKDRNHKLSLRLVKENVLIAFSADNHKGIAKKFGKSVSSSGHYQLQKMLSYKSRIGGTEYREIDSRNSTKTCSSCGALTGPTGLNGLSVRRWVCSACGAVLDRDINAAINTLVGAGAAHEEGLQNVA

SEQ ID NO: 2558 - protein, 350 aa, Unknown
  Description of Unknown: uncultivated organism sequence
  Category: MG81 effectors
  Description: MG81-843 effector
MVQVQLKLKLTPRQERQLNRWLCHLTAVWNWGVKKIENDARDRVFYTPKAFQNLLANHSQKVEIPSHVLQGILADAYLAWSRCFKGIARRPRLKGFRNRLNSIPLIDPVKRWPDRRISIPTLGRIRHHKQEVPEGKVKCGRIVKRASGWYLCLFIDAEPNAIPHVSDSEIGIDPGFKDLLALSSGEKMSHPRELEASALRLAQAQRGVNRKQVARLHERIANQRKDRNHKLSRRLVSENQLIAFSADNHKNIAKKFGKSVASSSHGQLRSMLAYKCRAGGREYIEVPSRNSTKTCSTCGALSGPSGWAGLKVRLWTCAHCGAEHDRDVNAAINTLKVGLGMSLELSARAA

SEQ ID NO: 2559 - protein, 341 aa, Unknown
  Description of Unknown: uncultivated organism sequence
  Category: MG81 effectors
  Description: MG81-844 effector
MIRTYRYRIKDSSAAPQLNKLAQACNFVWNFCNESQEHALRWDQRWPTGFDLNKLTAGCSKELGLHSQTVQAVCEQYETRRKQFKKRKLRWRGKRSPGWVPFKAVGVKVIEDTVRYAGHTFRFWKSRELPGPIKCGSFSQDSRKRWYVNFVIEVPEMEATTGTRHIGIDLGLKTLATCSDGRKIEAPRWYRNQQRRIAEHQRKKRSRQARNLQAKIAHRRKDFLHKESDRLTKECELIVVGDVCSSGLAKTNMAKSVNDASWSTFKHLLEYKAIARKVVYREVSERFSTQTCSGCGAIGGPKGREGLGIREWVCGECGSVHDRDVNAALNILRLGHQSLVL

SEQ ID NO: 2560 - protein, 355 aa, Unknown
  Description of Unknown: uncultivated organism sequence
  Category: MG81 effectors
  Description: MG81-845 effector
MKTLKLRIKDKHCKVLDQLASEVNFVWNYVNDLCFKHLKRKGEFLSAYDIAKYTKGTSKECNLHSQTIQAVTEELVTRRKQFKKAKLRWRVSNKKSAKKSLGWIPFKKVAIKYANGYVQYGKHQFKLWDSYGLTQYSVKTGSFVEDSRGRWYVCLVVDSPQQDKPTAIQAIGIDLGLKDIATCSDGTVISNPKFYRKYEQKLGIAQRAKNKNRVRALHAKIANCRKDHLHKASTMLVKNNALIVVGDLSAQKLVKTKMAKSVLDTGFSALKTMLKYKCENAGVMFEEVNERFTTQTCSSCLRVSNNSPKGRAGLRIRVWKCECGSVNQRDLTSSKNILALGHKRLAVGITVLSGR

SEQ ID NO: 2561 - protein, 367 aa, Unknown
  Description of Unknown: uncultivated organism sequence
  Category: MG81 effectors
  Description: MG81-846 effector
MKTLKLRIRDKHIAKLNRLSGSVNFVWNYVNDLSYKHLQKTGKFFSAYDLNEYTKGSGELLGLHSQTIQAINETHAKSRKQFKKAKLNWRTNNPTSKRKSLGWLPFKQSAIKHIATHQTGKKGLKSTLQLSLAKGQKLVIDLWDSYNLSLYQINTCELVQDSRNRWYACITVKEYPKTTCGTGSVGIDLGLKDSATASNGDKLQIKQTLKYAKALAIAQRAKNKQRVKAIHAKIKNTRQDLIHKFTTQLVKDNALIVVGDVKTTQFNSKKGTLAKSVYDAGWFEMRRQLTYKCENAGCRFEIVNEKYTTQTCSCCGDMSSSLSGRAGLRIREWTCAKCGTRHDRDINASRNILAVGLDRLVEGIPER

SEQ ID NO: 2562 - protein, 536 aa, Unknown
  Description of Unknown: uncultivated organism sequence
  Category: MG81 effectors
  Description: MG81-847 effector
MSDEEYKKLLKQYHKLSDRHILVVETDMPYPDVLKVVALSDKIRKAGNELVSLMRKNYDQLMRTKKYRKLLKLYGNTEDKDKRKALADQLNDMQKSYNVTWDLCRTSMIPIGKKYSIDAVFALTKAEDIWRGMEKCLYDNGKTTHFSKYGELPCIRAKQINRGIPMFVEDGKLRFKLRKMQFGIQVNDRFQSDEVNAVLSYLENPDKMDADAVNTLIEEACCIDTYRPCYATLVPRLIRGKYRVYLHLTIEGKAKPKYDRSGNPRHKYGKGMIGADIGTQTVAYTSDTEVGLKNLSERGNSIQTSERKERLYYRAMDRSRRATNPQNYNPDGTIKKGKKTWKYSDRYKKLKAKHAELCRINAVNKQIAINEDANYLRSLGDTFVTEPKNASKLMKRAKKTTVNSKGRFNKKKRFGKSIKNRCPPGFQTTVEKKFKVTGGAYIEVPNNYRASQYDHTADDYIKKKLSDRLYRLRDGTLVQRDWYSSFLLYCYDYRTQDIDKDKCITDFGRCYDKEKALIAWIKANHIKILNSGIKVA

SEQ ID NO: 2563 - protein, 536 aa, Unknown
  Description of Unknown: uncultivated organism sequence
  Category: MG81 effectors
  Description: MG81-848 effector
MSDEEYKKLLKQYHKLSDRHILVVETDMPYPDVLKVVALSDKIRKAGNELVRLMRKNYDQLMRTKKYRKLLKLYGNTEDKDKRKALADQLNDMQKSYNVTWDLCRTSMIPIGKKYSIDAVFALTKAEDIWRGMEKCLYDNGKTTHFSKYGELPCIRAKQINRGIPMFVEDGKLRFKLRKMQFGIQVNDRFQSDEVNAVLSYLENPDKMDADAVNTLIEEACCIDTYRPCYATLVPRLIRGKYRVYLHLTIEGKAKPKYDRSGNPRHKYGKGMIGADIGTQTVAYTSDTEVGLKNLSERGNSIQTSERKERLYYRAMDRSRRATNPQNYNPDGTIKKGKKTWKYSNRYKKLKAKHAELCRINAVNRQLAINEDANYLRSLGDTFVTEPKNASKLMKRAKKTTVNSKGKFNKKKRFGKSIKNRCPSGFQTTVEKKFKVTGGAYIEVPNNYRASQYDHTADDYIKKKLSDRLYRLRDGTLVQRDWYSSFLLYCYDYRTQDIDKDKCITDFGRCYDKEKALIAWIKANHIKILNSGIKVA

SEQ ID NO: 2564 - protein, 536 aa, Unknown
  Description of Unknown: uncultivated organism sequence
  Category: MG81 effectors
  Description: MG81-849 effector
MSDEEYKKLLKQYHKLSDRHILVVETDMPYPDVLKVVALSDKIRKAGNELVRLMRKNYDQLMRTKKYRKLLKLYGNTEDKDKRKALANQLNDMQKSYDVTWDFCRTSMIPIGKKYSIDAVFALTKAEDIWRGMEKCLYDNGKTTHFSKYGELPCIRAKQINRGIPMFVEDGKLRFKLRKMQFGIQVNDRFQSDEVNAVLSYLENPDKMDADAVNTLIEEACCIDTYRPCYATLVPRLIRGKYRVYLHLTIEGKAKSKYDRFGNPRHKYGKGMIGADIGTQTVAYTSDTEVGLKNLSERGNSIQTAERKERLYYRAMDRSRRATNPQNYNPDGTIKKGKKTWKYSDRYKKLKAKHTELCRINAVNRQLAINEDANYLRSLGDTFVTEPKNASKLMKRAKKTTVNSKGKFNKKKRFGKSIKNRCPSGFQTTIEKKFKVTGGAYIEVPNNYRASQYDHTADDYIKKKLSDRLYRLRDGTLVQRDWYSSFLLYCYDYRTQDIDKDKCITDFGRCYDKEKALIAWIKANHIKILNSGIKVA

SEQ ID NO: 2565 - protein, 512 aa, Unknown
  Description of Unknown: uncultivated organism sequence
  Category: MG81 effectors
  Description: MG81-850 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2566 - protein, 416 aa, Unknown
  Description of Unknown: uncultivated organism sequence
  Category: MG81 effectors
  Description: MG81-851 effector
MIWLEKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMDYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDSFKKLHDTEIENIRNEVMLRERKNISSYGIA

SEQ ID NO: 2567 - protein, 512 aa, Unknown
  Description of Unknown: uncultivated organism sequence
  Category: MG81 effectors
  Description: MG81-853 effector
MPTKQKEGGNRCVLTLPLLTEPWKEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTDRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2568 - protein, 512 aa, Unknown
  Description of Unknown: uncultivated organism sequence
  Category: MG81 effectors
  Description: MG81-854 effector
MPTKQKEGGNRCVLTLPLLTEPWQEHIIEKRFKIIEHLKNQLISIELRKLKNLQRTKAYKNLMKRIEFVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKICELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 2569 - protein, 469 aa, Unknown
  Description of Unknown: uncultivated organism sequence
  Category: MG81 effectors
  Description: MG81-855 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHD

SEQ ID NO: 2570 - protein, 537 aa, Unknown
  Description of Unknown: uncultivated organism sequence
  Category: MG81 effectors
  Description: MG81-856 effector
MISDEEYKKLLKQFHKLSDRHILVVETDMPYSDVLKVVILSDKIRKAGNELVSFMRKNYDQLIRTKKYRKLLKLYGSTKDKKKRKDLADQLNEMQKAYNVTWDYCRKSMIPIGKKYGIDAVFALTKAEDVWRGIEKCLYGNGKAIHFSKYGELPCIRAKQINRGISISVKDDRLQFKLGKTAFGIQVNDRFQQDEVDAVLTYLAEPEIVDNKAVNTLIEDAYYIDTYRPCYATLVIKMIRGKYRVYLHLTIEGKTKLKYDKHGNPRHKYGKGVIGADIGTQTVAYTSDTEVGLKNLSERGNSIQTSERKERLLYRAMDRSRRAANPQNYNEDGTVKKGRKTWKYSNHYKKLKAKHSELCRINAVNRQLAINEDANHLRSLGDTFVTEPKNASKLMKRAKETAVNDKGRFNKKKRFGKSIKNRCPSGFQTTVEKKFKTTGGTYIEVPNNYRASQYDHTVDDYIKKKLSDRLYKLQDGTEVQRDWYSSFLLYCYDYKIQNIDKNKCITKFDNCYKKEKALITWIKAHKIKVLNSGIKIA

SEQ ID NO: 2571 - protein, 364 aa, Unknown
  Description of Unknown: uncultivated organism sequence
  Category: MG81 effectors
  Description: MG81-857 effector
MVKTFSFRIKDSTSHKYLHAMARAVNYVWNYCNDIQKKAARSNRRWVNWVMLNNLTSGCSKELRLHSQTIQAIGECYATSLKEAKSPTGKKKRFLRFRGRRSQGWIPFKASGIKLRGDSAVYQGRRFKFWKTRDIPPTIKNGNFSCDSRGRWYLNLVCEYEETIVSNEGNVGIDLGLKSLATLSTGKKYDAQKFFRKYERKLAHHQRCNNSRQVQTIHAKIANSRKDFNHKVSHELTRDFNKIFVGDVGSLGLLKTKLAKSVSDASWGQLRTFIEYKAIARGGTYYVVDENNTTRTCSACGCLTGPSGLAGLRVREWQCKECGTVHDRDTNSAINIEQRGLLTLPSPLRTLSAKDSESLGIPRL

SEQ ID NO: 2572 - protein, 1268 aa, Unknown
  Description of Unknown: uncultivated organism sequence
  Category: MG81 effectors
  Description: MG81-858 effector
MKVSKVNHRRAAVAVNKKSVTVNGILYDAPVKKNVKTGNMSAYVSSKYVIDNVVKNSSRLYSPFSSKRIVIDREKIRIADRLKQCYDNFVKYYLSNGSLNEQQMRFNPNNTYMADSRVHFCVPSGIDIESLINSIVDCSLRKSLKRTYRFETNYGEKNTFNLPDLVKKSIKIYCTDEKRKLNDREEQEMYVLFSYMYEDKYKDRQKVLIANSISNQATKVKVCDDESRLIKLSIADTKKKPLWDFIVDYANSDKNGQYTILRNIRKSIVLFVCGVDVYRNIENNDNLDIWKWEEYGIQESQLFVKIENCYTTKGEDIALNEIRNVNLDHYMKAIGVLDDERSKFWFQHYENTIEALFSKKSKRKIERIKTAYLCEYLWKNFCSYVALKYVDLGKGVYHFTMSDKLSLMNKNTNENGIKFGEVDSRFNKGISSFDYERIKAEETIDRNISTYTTFATNIFAKSVIKDSYRQKKAGNSDALQYDDETYYNRKAMNPYALKRVLRYWGGQSRWKSELEELNVAELCIDIKNRLSKIRNSGVHYTSTSALKGNDDDSIVGMLIKKDFDDIKDVYASKYYSNNVWMFYNTDKISKMMEYLYQDDSNIRDAQIPAFNSVIKRKDMAEVIEKIIKKNSYKTIKEPYQREKYRSCLYFMLKEIYYNRFIKQDNLKDQVIQIIDSNTELIGDNSRAVDNLKKRIHDVDSQTMSFGELCQVIMTDYNMQNQENKSIKSKERQDKDRKNGIDNSYKHFPLLLHHLIKVSFLKFIKTDEKLAFIREPRITELDKTLEQFEAQIQTVDIYNSLKMMVAENKSLLDWYTLAHFLMPKQLNHLIGDVKNYIQYLSNIDKRAGSVKNNKSASTEVKIRQYSEIVRILDFSLQYIGRVSNDVTDYFVDEDEYAAFLSKYVEFSGNDIVSMKAFCQSRTANGKHTIGLYCDGANPIMNRNIAYAKMYGNDEILSYIYNKVTKKDIEKYYVSQDNLEKVFADGKCQDVQQQNALCDFQKMKNHIELTEVSIYTDILNDFMAQFISWAYLRERDLMYFQLGLNYIRMFYGTYELEEKYYKLHGENINIEKGALLYQIVAMYSHELPIYKVDESGIAILAEKQGSSGASIKSFVTEYCKEEMKKAYTYENGLELFEDVNQHDDLSKLRNDFAHMRYMSARDKSIMDIVSEIYNGFFIYDTKLKKSVSFIFKNILMRYAVDVNIEFCHKGDNEDTNNLIRIKDEVGLYSDKYTYKVEDNDTVDIEVRNSEFLEQLKKLLEYKKESEGSEL

SEQ ID NO: 2573 - protein, 1268 aa, Unknown
  Description of Unknown: uncultivated organism sequence
  Category: MG81 effectors
  Description: MG81-859 effector
MKVSKVNHRRAAVAVNKKSVTVNGILYDAPVKKNVKTGNMSAYVSSKYVIDNVVKNSSRLYSPFSSKRIVIDREKIRIADRLKQCYDNFVKYYLSNGSLNEQQMRFNPNNTYMADSRVHFCVPSGIDIESLINSIVDSSLRKSLKRTYRFETNYGEKNTFNLPDLVKKSIKIYCTDEKRKLNDREEQEMYVLFSYMYEDKYKDRQKVLIANSISNQATKVKVCDDESRLIKLSIADTKKKPLWDFIVDYANSDKNGQYTILRNIRKSIVLFVCGVDVYRNIENNDNLDIWKWEEYGIQESQLFVKIENCYTTKGEDIALNEIRNVNLDHYMKAIGVLDDERSKFWFQHYENTIEALFSKKSKRKIERIKTAYLCEYLWKNFCSYVALKYVDLGKGVYHFTMSDKLSLMNKNTNENGIKFGEVDSRFNKGISSFDYERIKAEETIDRNISTYTTFATNIFAKSVIKDSYRQKKAGNSDALQYDDETYYNRKAMNPYALKRVLRYWGGQSRWKSELEELNVAELCIDIKNRLSKIRNSGVHYTSTSALKGNDDDSIVGMLIKKDFDDIKDVYASKYYSNNVWMFYNTDKISKMMEYLYQDDSNIRDAQIPAFNSVIKRKDMAEVIEKIIKKNSYKTIKEPYQREKYRSCLYFMLKEIYYNRFIKQDNLKDQVIQIIDSNTELIGDNSRAVDNLKKRIHDVDSQTMSFGELCQVIMTDYNMQNQENKSIKSKERQDKDRKNGIDNSYKHFPLLLHHLIKVSFLKFIKTDEKLAFIREPRITELDKTLEQFEAQIQTVDIYNSLKMMVAENKSLLDWYTLAHFLMPKQLNHLIGDVKNYIQYLSNIDKRAGSVKNNKSASTEVKIRQYSEIVRILDFSLQYIGRVSNDVTDYFVDEDEYAAFLSKYVEFSGNDIVSMKAFCQSRTANGKHTIGLYCDGANPIMNRNIAYAKMYGNDEILSYIYNKVTKKDIEKYYVSQDNLEKVFADGKCQDVQQQNALCDFQKMKNHIELTEVSIYTDILNDFMAQFISWAYLRERDLMYFQLGLNYIRMFYGTYELEEKYYKLHGENINIEKGALLYQIVAMYSHELPIYKVDESGIAILAEKQGSSGASIKSFVTEYCKEEMKKAYTYENGLELFEDVNQHDDLSKLRNDFAHMRYMSARDKSIMDIVSEIYNGFFIYDTKLKKSVSFIFKNILMRYAVDVNIEFCHKGDNEDTNNLIRIKDEVGLYSDKYTYKVEDNDTVDIEVRNSEFLEQLKKLLEYKKESEGSEL

SEQ ID NO: 2574 - protein, 1073 aa, Unknown
  Description of Unknown: uncultivated organism sequence
  Category: MG81 effectors
  Description: MG81-860 effector
MQVRDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELDNPLAGEEVRCRYAELAFAQRPLAPVSHMVGPCAFLEGERRAPRFAPTAELFRYVQALCNMRLRQETGEETPLSEEQRQAACTVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGTARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPDWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVVLQRGSGQAQASNGGMVRTDIYSRDGKFYMVPVYAKDVADKRLPLRACVAAKAEKDWREMTADYRFLFSLTPDCYVLTENRKGEVKEGYFAGANRNTSAISLSLAHDKQNVIQHRHHHVKAF

SEQ ID NO: 2575 - protein, 1098 aa, Unknown
  Description of Unknown: uncultivated organism sequence
  Category: MG81 effectors
  Description: MG81-861 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPQIAALSQAAGEGKLGIFQGTARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPDWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVVLQRGSGQAQASNGGMVRTDIYSRDGKFYMVPVYAKDVADKRLPLRACVAAKAEKDWREMTADYRFLFSLTPDCYVLTENRKGEVKEGYFAGANRNTSAISLSLAHDKQNVIQGIGITTLKRFEKYRVDRFGRLSLVRREADPRGRS

SEQ ID NO: 2576 - protein, 1098 aa, Unknown
  Description of Unknown: uncultivated organism sequence
  Category: MG81 effectors
  Description: MG81-862 effector
MQVRDDVILGLDIGVGSLGWALLEEDLQTGEQRLLQRQTSQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACTVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGTARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPEAVSAGEVQRYELWRQQDGKCAYYMLWRHAGGERAYGNAMPQGSIPPAWLADGVNAVQVDHILPRSRTFDNSFHNLCLCCHAANQAKGGRTPWEWLGAAQPQAWHDFEQWVQSLPLKGLKKRNYLLRDLSAEVQGRFHARNLTDSSYVARLTLRWLEEEYARHDVPMQDAEGRTRRRFFARPGQVTDFLRRHWGVQALKKIDGQRSGDRHHALDALLVAACSEGMLQRMVRAFQREENGPERLHIPCPWQDFSTTVGRALGSVFVSRVERGRTKGPLHEETLRAIREERQPDGETRRVLYERKAVARLTAADLDRIKDAARCPDVVAALRRWLDAGKPGDDLPRSAHGDIIRHVRVRAGEFSSGVILQRGSGQAQAKNGGIVRTDIYSRDGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRS

SEQ ID NO: 2577 - protein, 1134 aa, Unknown
  Description of Unknown: uncultivated organism sequence
  Category: MG81 effectors
  Description: MG81-863 effector
MKYVIGMDIGIGSIGWSVIRSDADCKRIEDFGVRIFDPGENASDRKSNSQIRHEYRSVRRVLRRRKHRKELLKAHLENIGLTTIDRINEYFKHADGDIISLRVKGLDKKLAPEEIAACLINIANRRGYRPFYEKEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIESALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLKGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLRGSKAYEIDHIVPFSLILDNTLNNKALVLTNENQLKKQQTPLMYLSGERRKKFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKDFEKPTYEEAEQAYRTSMENLYPTDLQFAHSLSMPLISCKPERKFSGKITADNPVKLREIDGKLYTLSKKEIGKIERKDIEKIYTSDTQLIAYLIELFDGAKDTATLGDIMKEKGISEIRTKNGNAIRKLTLRNICNKDFLKKEIDENNYTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYSVDILGKIGKKEIKCGEPLSSAKVKK

SEQ ID NO: 2578 - protein, 1323 aa, Unknown
  Description of Unknown: uncultivated organism sequence
  Category: MG81 effectors
  Description: MG81-864 effector
MKVSKVDHTSAGVTSKKDITYNGLLYRNPPKKGVNEILKDAETDEKILENMENYITRLNNRASSLYSVFNPIGNEKSQAKNPEQKDLYQNISSYFTEFVRDIKNNSADTASRNLLNRSFTVNSDKETIDNFVARYLRKSLQKRVNGYELSEIIRNIIYLKANLYRKEDVPVKEVCILAEAIKEDITKERQIKKMAASIVKQDVKIQTYLSDDGKVLLRHTFAKHSKKSALFRFLQRFTSVDIEEQEEMIRELRALVVLFYCGPNAYKEAQGDGIGVWTFGKTASDVRVNFCEEACRLITEYQAELERVETEKKEKSSNVKPVNTDIYKEKIKKAIRYSIAGSYQEAARTLKETEGFEDKRLWLGLIEEYAERILLSNRRFMDPGTQNCEFLCKRTMQMLISYIAMKLVDLGKAVYHFAMPAQIDVTNGKSAEFGEVQPSFRDGITSFDYEWIKAEESLTRELSTYSVFAVRNFLNSISKKESDIIAVNLNDVESGNLKSNSVMRVLRYFGGKKEWQDTYIGEVSENELINALRKEIGAARNSTFHYAGTIDNGITDDDKLIISQIYEKEHGDIGRIRRKKYYSNNALMFYKKTDIDALMDYLYSAPKDHPAQIPAFNKILNKNKVYEFSKFIKGNPKKKISTAGKTEELKGCVFYMLKECYYYGFLPDSRSAQFVKEALEDIVKSAEDADPAATDRRLEAAQNFKKRFYEISEKASLGQICQRIMTDFQLQNGGQKKGQSSKYAKKGVGEPIYQHFRMMLYDILRKAFWKYLNTLTETGEMNFMFMREPSYKPEFAAEEEFCKDWNDHSYDDIREGMEEDSYLEAWFTAAHFIAPAQLNHLIGSFKKYEQFTSDIKYRAEGNGIDCNSRWQSRIQEDEMHRLLRVLEFVQMTSGTFSKEISDYYGRDEDSAIEEYAEFVENFVEFSTKKMPNKHVALQTFCNTAVKSGSPNGKIGIYYDGEKPILNRNIVMADMYGNVSLISNCMKKVTEREIKVFYNDMNNLTEVFKRGVCQNEDEQKRLKAFQNNKNRVELLDVAIYTEIVNELYAQLVSWSYLRERDLMYYQLGVNYMKLFNGNSVPKDSFLRIIQGNGANITEGAVLYQLVAMNSFGWPLLCRDGSADKKANTTGQKVASFFMDYCRKDASIYESCLMLFERLQSHDAIIKEIRNPIDHMHYFEKGKNGATKSILEMYGDIYDRFFDYDLKLKKSVSFVLQNILLDHFIIAHTVMNRQEGKYKYKNKDGQEKSYTGTKLAIRPNREQKKKVFDKTIRKMKEISIIHYGMESDILTYKIKKDGKPVLVKADARSRMFLDQMQRILEYSKT

SEQ ID NO: 2579 - protein, 1034 aa, Unknown
  Description of Unknown: uncultivated organism sequence
  Category: MG81 effectors
  Description: MG81-865 effector
MARVLGLDIGIGSCGWAVVETPEIDEATGKVQGEAAIVACGTRCFDVPEEPKTKELKNKTRRLLRGQRRVLRRRRQRIAQIRRLLATHGLPADPGPLPAGAPGDLVWRLRAQGLDRRLEPAEWARVLIHIANHRGFKSNSKRDRGNKSESGKMLKAIAATGQKLADWRSFGEMLARDPDFAARKRNRTGEYALTPLRADLEREVARLFEAQRRLANPASSPALEAAYRELAFAQRPVAAREPPVGRCAFLEGEKRAPRHAPSFERFRFLAKLATVKVIPMGERPRFLTDEERPRAIGLLGRQELVTYKALRNALELPPSTVFADLPQRKADPESAPFARFDGTLALREGLGKRRFTELLRSAPEKLDAAMEALVWLDDLDQIRARLAASGLDPADVAALTGDEALARFAGFKGAGHISTAACRALIPHLEHGRGYAEACAALGWDHAKAGVPRIEEVANPVVRKILRECTRQIAVVLAEHGPVDAVHLEMARDVGKSAEERNEIRKGMDERAAQRDRHREEFRKLLGHAPNDEELLRYELWKEQNHRCPYTFPDEAAYIPPECLLATDNRVQVDHILPYSRSGDDSFRNKVLCYVRANQEKRRRTPYEWLGDDPQRWRLFEARIAGLADMHHQKRRKLLMRTFADREQAYRARHLQDTRYAMRVLRFALEAQFPTDARRRLFPRPGAITALLRRAWGLDELKKGGALGDRDHALDAIVVAFTTESLLNRLTRLHQELEEIGSGRATPLVETPLGSSPQARERFRQMVKAAAEGVFVSRPETRRGRGPAHDATLYGFERTPEGQEIQYERKNVWELKAADLDRLKGDPARHRVLREVLGAWLQRAEERRVKPEKLWREEPPRLPNGPPVRSVVLVRAKTTAGVKLQRGNALAHADQASMVRVDVFTKGGKFFLVPIYAWQVAKLETPPFLAIKSLADEDGWYPIDDTYAFLWSLYPGSFIKAVNRKGERFEGYFRSLDRSNGRISFSPPGNGDSKAQERFTTKTLQVFEKYHVDRLGRLHRIEREPRLWHGAVCS

SEQ ID NO: 2580 - protein, 1098 aa, Unknown
  Description of Unknown: uncultivated organism sequence
  Category: MG81 effectors
  Description: MG81-866 effector
MQVRDDVILGLDIGVGSLGWALLEEDLQTGEQRLLQRQAPQGETSYALGVRLFNVPENAKTKELLNVKRRTARMQRRTTARRAQRMRRVRALLDSLGVLGVRDADAFHLGKGRGAQCDPWQLRREGLERRLEAREWAVVLLHIAKHRGFRSNSKTDSSGSDKEMGQVLQAVSNLQQEVEASGLTVGALLASRERRRNRADHTGAPRYDLCMLRSLQEDEVNILFTRQRELGNPLAGEDIRCRYAELAFAQRPLAPVSHMVGPCAFLEGERRAPRFAPTAELFRYVQALCTMRLRQETGEETPLSEEQRQAACAVFGSVQSVTYKKLRQVLRLPAGCRFVGLSYGVTEKGKVQDPEKADVVMRTGKCCQGTACLRGILGDAYDALHEQRLDEADAARLAATDALSAPAAALLARGMAGLRLTDALVRIVSELNDLGQIRAILALLPLPAPRIAALSQAAGEGKLGFFQGTARLSLRAMEAILPHMQACGEYAAACELAGFDPRAAQKTDVTDIRNPVVLRVFREVRRQFSAICREFGFLPGRVHVELLREVGKSGEERNRISRGLERRTKEKEAARKAVAQLLGKSPEAVSAGEVQRYELWRQQDGKCAYYMLWRHAGGERAYGNAMPQGSIPPAWLADGVNAVQVDHILPRSRTFDNSFHNLCLCCHAANQAKGGRTPWEWLGAAQPQAWHDFEQWVQSLPLKGLKKRNYLLRDLSAEVQGRFHARNLTDSSYVARLTLRWLEEEYARHDVPMQDAEGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDRIKDAARCPDVVAALRRWLDAGKPGDALPRSAHGDIIRHVRVCAGEFSSGVVLQRGSGQAQASNGGMVRTDIYSRDGKFYMVPVYAKDVADRRLPLRACVAAKAEKDWREMTADYRFLFSLTPDCYVLTENRKGEVKEGYFIGSDRSTAAISLSLAHDRQQSLRGIGITTLKRFEKYRVDRFGRLSPVRREADPRGRS

SEQ ID NO: 2581 - protein, 313 aa, Unknown
  Description of Unknown: uncultivated organism sequence
  Category: MG81 effectors
  Description: MG81-867 effector
MVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVRRGTKGHKLKWNKSKHYLEIAGKIRELERKNSDIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDTEIENIRNEVMLRERKNISSYGIA

SEQ ID NO: 2582 - protein, 500 aa, Unknown
  Description of Unknown: uncultivated organism sequence
  Category: MG81 effectors
  Description: MG81-868 effector
MLTLPLLTEPWQEHIIEKRFKIIEHLKNQLISIELKKLKNLQRTKAYKNLIKQIESVPKSERTALYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 2583 - protein, 192 aa, Unknown
  Description of Unknown: uncultivated organism sequence
  Category: MG81 effectors
  Description: MG81-869 effector
MCLEYLILYPDSNEHIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2584 - protein, 1099 aa, Unknown
  Description of Unknown: uncultivated organism sequence
  Category: MG81 effectors
  Description: MG81-870 effector
MQVRDDVILGLDIGVGSLGWALLEEDLQTGEQRLLQRQTPQGETTYALGVRLFHVPEKNAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDALVRIVSELNDLGQIRALLALLPLPAPRIAALSQAAGEGKLGFFQGTARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPDWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVILQRGSGQAQAKNGGIVRTDIYSRDGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRS

SEQ ID NO: 2585 - protein, 512 aa, Unknown
  Description of Unknown: uncultivated organism sequence
  Category: MG81 effectors
  Description: MG81-871 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSAFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 2586 - protein, 353 aa, Unknown
  Description of Unknown: uncultivated organism sequence
  Category: MG81 effectors
  Description: MG81-872 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADKGVTVWVQILLKVNFANP

SEQ ID NO: 2587 - protein, 521 aa, Unknown
  Description of Unknown: uncultivated organism sequence
  Category: MG81 effectors
  Description: MG81-873 effector
MLILGRRMYMPTKQKEDSNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSIASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNSDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 2588 - protein, 512 aa, Unknown
  Description of Unknown: uncultivated organism sequence
  Category: MG81 effectors
  Description: MG81-874 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKRLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2589 - protein, 583 aa, Unknown
  Description of Unknown: uncultivated organism sequence
  Category: MG81 effectors
  Description: MG81-875 effector
MVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPAWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRWRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAAARLTAADLDKIKDAARCPDVVAALRRWLNAGKPGDALPRSAHGDIIRHVRVCAGEFSSGVVLQRGSGQAQASNGGMVRTDIYSRDGKFYMVPVYAKDVADKRLPLRACVAAKAEKDWREMTADYRFLFSLTPDCYVLTENRKGEVKEGYFAGANRNTSAISLSLAHDKQNVIQGIGITTLKRFEKYRVDRFGRLSLVRREADPRGRS

SEQ ID NO: 2590 - protein, 512 aa, Unknown
  Description of Unknown: uncultivated organism sequence
  Category: MG81 effectors
  Description: MG81-876 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHVKKCELQRKLDRSRRYTNPDNFNPDGTVKRGTKGHKLKWNKSKHYIEIAGKIRELERKNTDIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2591 - protein, 540 aa, Unknown
  Description of Unknown: uncultivated organism sequence
  Category: MG81 effectors
  Description: MG81-877 effector
MATTDKKDEENLRAYKFRLDPNQAQTTALYQAVGAARYTYNMLTAYNLEVNRLRDDYWKRRHDEDISDADIKKELNALAKEDKRYKQLNYGAFGTQYLTPEKKRHEQAEHRIENGEDPSVVWNQETERSANPWLHTANQRVLVSGLQNASDAWDNFWASRTGKRAGRLVGTPRFKKKGVSRDSFTVPAPEKMGAYGTAYLRGEPAYKQGRRKITDYRHVRLSYLGTIRTFNSTKPLVKAVVAGAKIRSYTVSRNADRWYVSFLVKFSEPIRRSATKRARAAGSVGVDLGVKYLASLSDSEAPQRFPNLKFVEGLPSLENPRWSEASSRRLHKLQRALARSQKGSNRRSRLVKQIARLHHMTALRRESNLQQLTKKLATGYTLVGFEDLNVSGMTASAKGTVENPGKNVAQKSGLNRVVLDAAFGVFRNQLEYKAVWYGSAFEKVNRYFASSQTCSECGRKAKTKLTLRDRVFDCAYCGNMMDRDLNAAVNICREAQRLFDEKLASEDRESLNGRGSRGALRGAETVEASRPPASHRRGSP

SEQ ID NO: 2592 - protein, 1098 aa, Unknown
  Description of Unknown: uncultivated organism sequence
  Category: MG81 effectors
  Description: MG81-878 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELDNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGSARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPDWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVVLQRGSGQAQASNGGMVRTDIYSRDGKFYMVPVYAKDVADKRLPLRACVAAKAEKDWREMTADYRFLFSLTPDCYVLTENRKGEVKEGYFAGANRNTSAISLSLAHDKQNVIQGIGITTLKRFEKYRVDRFGRLSLVRREADPRGRS

SEQ ID NO: 2593 - protein, 1268 aa, Unknown
  Description of Unknown: uncultivated organism sequence
  Category: MG81 effectors
  Description: MG81-879 effector
MKVSKVNHRRAAVAVNKKSVTVNGILYDAPVKKNVKTGNMSAYVSSKYVIDNVVKNSSRLYSPFSSKRIVIDREKIRIADRLKQCYVNFVKYYLSNGSLNEQQMRFNPNNTYMADSRVHFCVPSGIDKESLIDSIVDSSLRKSLKRTYRFETNYGEKITFNLPDLVKKSIKIYCTDEKRKLNDREEQEMYVLFSYMYEDKYKDRQKVLIANSISNQATKVKVCDDESSLIKLSIADTKKKPLWDFIVDYANSDKNGQYTILRNIRKSIVLFVCGVDVYRNIENNDNLDIWKWEEYGIQESQLFVKIENCYTTKDEDIALNEIRNVNLDHYMKAIGVLDDERSKFWFQHYENTIEALFSKKSKRKIERIKTAYLCEYLWKNFCSYVALKYIDLGKGVYHFTMSDKLSLMNKNTNENGIKFGEVDSRFNKGISSFDYERIKAEETIDRNISTYTTFATNIFAKSVIKDSYIQKKAGNSDALQYDDETYYNRKAMNPDALKRVLQYWGGQSRWKSELEELNVAELCIDIKNRLSKIRNSGVHYTSTSTLKGNDDDSIVGMLIKKDFDDIKDVYASKYYSNNVWIFYNTDKISKMMEYLYQDDSNIRDAQIPAFNSVIKRKDMAEVIEKIIKKNSYKTIKEPYQREKYRSCLYFMLKEIYYNRFIKQDDLKDQVIQIIDSNTELIGDNSRAVDNLKKRIHDVDSQTMSFGELCQVIMTDYNMQNQENKSIKSKERQDKDRKNGIDNSYKHFPLLLHHLIKVSFLKFIKTDEKLAFIREPRITEYDKTLEQFEAQIQTVDIYNSLKMMVAENKSLLDWYTLAHFLMPKQLNHLIGDIKNYIQYLSNIDKRAGSVKNNKSASTEVKIRQYSEIVRILDFSLQYIGRASNDVTDYFVDEDEYAAFLSKYVEFSGNNTVSMKAFCQSRTANGKHTIGLYFDGANPIMNRNIVYAKMYGNDEILSYIYNKVTKKDIEKYYVSQDNLEKVFADGKCQDVQQQNALCDFQKMKNHIELTEVSIYTDILNDFMAQFISWAYFRERDLMYFQLGLNYIRIFYGTYELEEKYNKLHGENINIEKGALLYQIVAMYSHELPIYKVDESDIAILAEKQGSSGASIKSFVTEYCKEEMKKAYTYENGLELFEDVNRHDNLSKLRNDFAHMRYMSARDKSIMDIVSEIYNGFFIYDTKLKKSVSFIFKNILMRYAVDVNIEFCHKGDNEDTNNLIRIKDEVGLYSDKYTYKVEDNDTVDIEVRNSEFLEQLKKLLEYKKESKGSEL

SEQ ID NO: 2594 - protein, 512 aa, Unknown
  Description of Unknown: uncultivated organism sequence
  Category: MG81 effectors
  Description: MG81-880 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANNILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 2595 - protein, 512 aa, Unknown
  Description of Unknown: uncultivated organism sequence
  Category: MG81 effectors
  Description: MG81-881 effector
MPTKQKEGGNRCVLTLPLLTEPWQEHIIEKRFKIIEHLKNQLISIELRKLKNLQRTKAYKNLMKRIESVPKSERTALYKERNKMLKDAGFSQYTFMDDMAGKKRLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMLYRASQCDHTTGEYTKHGLNDRWRILGNGDKVQRDLYSAFLIKNSNKTHDEIDLDKCSKTYDNFKKLHDKEIENIRNEVKLRERRNISSYGIA

SEQ ID NO: 2596 - protein, 482 aa, Unknown
  Description of Unknown: uncultivated organism sequence
  Category: MG81 effectors
  Description: MG81-885 effector
MPTKQKEGGNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEICLLYTSDAAAN

SEQ ID NO: 2597 - protein, 1134 aa, Unknown
  Description of Unknown: uncultivated organism sequence
  Category: MG81 effectors
  Description: MG81-886 effector
MKYVIGMDIGIGSIGWSVIRSDADCKRIEDFGVRIFEPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKLTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKAYEIDHIVPFSLILDNTLNNKALVLTSENQLKKQQTPLMYLSGERRKNFIGTVNELFRAKKIKKKKYAYLLQPDLNDEKMSEWKSRNLNDMRHISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHGLSMPLISCKPERKYRGEITAANPVKLREIDGKLYTLSKKEIGKIERKDIEKIYTSDANLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2598 - protein, 1134 aa, Unknown
  Description of Unknown: uncultivated organism sequence
  Category: MG81 effectors
  Description: MG81-887 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNGPFRRYTGFLESMGQCRFYPDEKRGYRATLTADTYSLVNELSQYSYVDENGCFVFDSALAHDLIASALKNAKFTKSDFNKICKAHGIVSIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLRGSKAYEIDHIVPFSLILDNTLNNKALVLTSENQSKKQQTPLMYLSGERRKNFIGTVNELFRAKKIKKKKYAYLLQPDLNDEKMSEWKSRNLNDMRHISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHGLSMPLISCKPERKYRGEITAANPVKLREIDGKLYTLSRKEIGKIERKDIEKIYTSDTQLIAYLIELFDGAKDTATLGDIMKEKSISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYSVDILGKIGKKEIKCGEPLSSAKVKK

SEQ ID NO: 2599 - protein, 558 aa, Unknown
  Description of Unknown: uncultivated organism sequence
  Category: MG81 effectors
  Description: MG81-888 effector
MVKKTSTDADTTLRAYKFRLDPTQAQKIALAQCAGAARYAYNLLTAHNLEVSRTRADYWHTRIDAGADETTVKADLKALAKSDVAYKSIGYAAYGTQYLTPEINRHRAASNAITDGADPTAVWPETERSSEPWMHTIPRRVLVSGLQSADKAWKNFFDSRTGARAGRLVGTPRFKRKGSSRDSFTVHHETTGAYGTYYHKKDPEYARRKAQLKRRGINAKPTITDYRHVRLSHLGVIRTHNTTKPLVKAVRAGAQIRSYTVSRAANRWYVSILVELTRPSATPTHAQRSAGAVGVDLGVRYLAVLSDEQAPQRFARYPSLEFTGDGAPTLANPRWARAAEKRLVRLQRALARAQKGSKRRARLVQQIARHHHLVALRRESGLHQVSKRLTTGYTLIGLEDLAVAGMTASAAGTVEAPGKNVRQKAGLNRSILDAAFSTLRRQLEYKSSWYGSQVQIIDRFFASSQTCSACGARTKTKLDLRVRVFECAACGVRIDRDVNAARNIRAEAVRMYEAQLAPGTGESLNGRGATDSDAAGSVALGDVALDAPRPAASGGGSP

SEQ ID NO: 2600 - protein, 567 aa, Unknown
  Description of Unknown: uncultivated organism sequence
  Category: MG81 effectors
  Description: MG81-889 effector
MAKRKKHQITEYEKCLREYHKASPRHVIVLETDLLEDEKRHLFHQADLLRQCGNELLGIMKRHLDQLLRTKKYRGLRKSYGKISKSIKNLQQIKKLSNVQKQHLKDLQKDLRTISNLMNEMQKSYHVTWEYCRNTMKTLRLKYEQTSVIALSRAEDIWTAVSKVLYSDGERLHFKKRGDLSELRAKQFHKEIIGRVKNGFLEFRYGKVSLPVIRKETDLWLMNELEAVESYLKDPDFHDAYAINQMQQGEIVSTYRPCYASIVCKTIRGKLRVYLHLTVEGLPFSKRTNDGIIKHPYGNGPVGCDIGTQTIAYTSDHTVGLENLAERGNSICYVERWQRLVQRAMDRSRRAMNPDNYNDDGTIRKGKKTWIKSKRYQKLQLRYRELCRISAENRRLAIHEQVHKMRSLGDIFVTEAKNAKKLQKRANPENPLDKNGRPKRKKRFGRSIQNRCPGYFQAKVKQLFESTGGTYIEVPSDYRASQYDHTVDDYIKKKLSQRMYNLKDGTKVQRDWYSSFLLYCIDLITKTIDRQKCLATFETQLNKEHAMIEEIIHLKKHIMNSGIRVAV

SEQ ID NO: 2601 - protein, 1134 aa, Unknown
  Description of Unknown: uncultivated organism sequence
  Category: MG81 effectors
  Description: MG81-890 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESIKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLRGSKAYEIDHIVPFSLILDNTLNNKALVLTSENQLKKQQTPLMYLSGEQRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEVADHEGKDFKKPTYEEAEQAYRVSMENLYPTDLQFAHGLSMPLISCKPERKYRGEITAANPVKLREIDGKLYTLSKKEIGKIERKDIEKIYTSDANLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2602 - protein, 359 aa, Unknown
  Description of Unknown: uncultivated organism sequence
  Category: MG81 effectors
  Description: MG81-891 effector
MRGYSVTGKSGGVEIIFRETYIEWKGLKLPLKRSPDNAYETEMLSRRVKYVRLLRKPGKRKDRWYAQLSLEGKPAIKHDPESGELRHAIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNDMPDGERIQRDLYSAFLLQHYDPQAGNFNSALLQQDYPQFVQYHHRAIQRLSTAPKTLSSMGIQRSLR

SEQ ID NO: 2603 - protein, 495 aa, Unknown
  Description of Unknown: uncultivated organism sequence
  Category: MG81 effectors
  Description: MG81-892 effector
MPKEEKESCCVLQLRLYPEPWQVQIIETRFKVLEHLKNSLIALELRKLRNLERTRAYREIQEQIKLADDKSKIKLYAKRRKLLKDAGFSEFVFKDDITPMQKHFAAHIATHVAHRAASEVWRAFDKFLFGNGKMVHYVRRGTLRSASNQTAGTTMTLENGYFKWNGGRDQNSIAINIRVAKPTTYYEKEMLQKKAKYFRIVRKWGKIGYKYYLQITLAGLPAVKPRLIANEKKVGIDIGPSSIAIVSDKKVELRALADKVQNNHIEKCSLQRSMDRSRRNLNPQNYNEDGTIRRGIRLNWTFSKHYIEMRGKVRMLERKNVDIRKYQHTCLANEVILLGTDVYIEQMSFKGLQRRAKETTYREDGRPKRKKRFGKSIANRAPAMFVEILGRKLTTIVGTELNKVDTFKFRASQYDHTNGSYKKKLLKERWAQLSNGDRIQRDLYSAFLLKNSNADLNSTNVEQCNATYDAFKIMHDDCITKLKSEKKSCLPSFGV

SEQ ID NO: 2604 - protein, 521 aa, Unknown
  Description of Unknown: uncultivated organism sequence
  Category: MG81 effectors
  Description: MG81-893 effector
MMVTWKGGIPVGKSSTDTCCLTLPLKLEKWQEDRLAKRFEIARQIYNTMVRAELKKLDRVKQLPEYRKNQKEIQALDGKNSADRARLKELRANQNRILQKQGFTKYGFKSDSKDYYKHFIENIGSSVATHCIAPQVWNAFDKMLFQKDGKVVHFKRYGDVHSLKGGSVTNKSGGAEIMFRKTYIEWKGLKLPLKLSPNNAYEAEMLSYRVKYVRILRTRGKTKDRWYAQLSLEGKPAVKYDSSTGKPVHPVGRGAVGLDIGPQTLAYAAANEANLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEETGRIKRKKRFGKSVANKAPASLIGILRLKCISLGLTGVVEVPMLLRASQYNHQSKDYAKKSLSQRWNDMPDGNRIQRDLYSAFLLQHYNSQSESFDQETLERDYPQFVRLHNQTIQRLSALPKTPSSMGIRRSVS

SEQ ID NO: 2605 - protein, 541 aa, Unknown
  Description of Unknown: uncultivated organism sequence
  Category: MG81 effectors
  Description: MG81-894 effector
MVQSTADAEAKSVMYRAYKFRLDPNNEQVKALYQAAGAARYTYNMMTAYNLEIKKNRDEFWYAHITEDSDEQYKKQVESQLKALEKAEPARYKPLCQYASFSTQKLTPAKHKHKEVSEAIAQGVLPNDAWGSEEHPKNPWLHEANQRVLVSGLQNSAKAWKNFWDSQTGRRKGAKVNLPRLKKRGISRDSFTVPAPEAMGGYGAPYKNDSEQYKRLKKKGKDAVIQDYRHVRLSYLGVLRTFNSTKPLAKAVNTGAKIKSYTVSRNADRWYVSFLVELSEPIARPATKKQRAAGGVGIDLGVKTLVTLSDESNPYIANLRPGQRAQRKLKKLQQKFARSQKGSNRRARLAAEIARLHHKVALRRKGYLDQVTKGLVTQYSAVACEDLNVSGMVHSAKGTVENPGKNVAAKSGLNRSILDASFGMFIRQLEYKSAWYGSVVLKVDKWFPSSRTCFNCGEVKSKLPLSERVYDCQYCGYSADRDLNAARNILEQAYKEKEDKQNPQFAPERGENSNGRGRGSTCSVESGETSRPADGSAGHRR

SEQ ID NO: 2606 - protein, 519 aa, Unknown
  Description of Unknown: uncultivated organism sequence
  Category: MG81 effectors
  Description: MG81-895 effector
MIQPELKAYRRCSDRHVLVLETNLTYVEKCQIFHYADLVRKAGNELTGIMKKRYDQLVRTKRYRKLKSLYKKYKDADNKKALKDICDQMKEMQKQYDVTWDYCRTSMIPIGKKYGIDAVFALTKAENVFRGIEKCLYSDGETIHFKKRGDLPCIRAKQINRGIIMKQMNFKFKDIEFGVKIKDRYEQEEVNAILYYLKHAEFMDFIAANTYKETNICISTYRPCYVSLVCKKIRGKLRVYVHITIEGLSKPKQDRFGNFKHNKGKGIVGCDIGTQTIAYTTETKAGLKNLAERGSCIEVNERKERRIYRAMDRSRRAMNPDNYNEDGTIKKGKKKWTYSNRYKKLRTKHTELCRINATNRHLAINEDVNELRSLGDVFVTEPKNAKKLQKKAKTGKRKKRFGRSIKNRCPGYFQSQAKRKFRIYVEVPNDYKASQYDHTSDEYIKKSLSQRMYKLSDGTMVQRDLYSSFLLYCIDLNTNRIDKNKCIHEFKKQYKNQNETIEYIQMNQIKVMNSGIRVN

SEQ ID NO: 2607 - protein, 587 aa, Unknown
  Description of Unknown: uncultivated organism sequence
  Category: MG81 effectors
  Description: MG81-896 effector
MRKGNKPTDGLLWYPRRAVFDTSHQKRPCALRGGNGGHDAGWARSRWRTALTTGTGACYAPVSGGERTDSPTEVGRHPDAFEVTLPRLFAFGFGCGGFVLREAFMADHRKIYNTMVRAELKKLDRVKQLPEYRKNQKEIQALDWKNSADKQRLKELYGNQRKILQKQGFTEYGFKSDSKDYYKHFIENIGSSVATHGIAPQVWNAFDKMLFQKDGKVVHFKRYGDVHSLKGGSVAHKSGGAEIMFRKTYIEWKGLKLPLKLSPNNAYEAEMLSYRVKYVRILRTRGKTKDRWYAQLSLEGKPAVKYDSNTGKPVHPVGRGAVGLDIGPQTLAYAAANEENLVELADQVQNIEQEKRRLQRKLDRSRRATNPDNYNENGTIRRGVKLTHNKSKRYCKLQKELSWIQHCQAETRKRQHIALANHLLSLGDCFYVEPMAWPSLTHRAKKTEVSEKTGRIKRKKRFGKSVANKAPASLIGILKLKCISLGLTGVVEVPMLLRASQYNHQSKDYAKKSLSQRWNDMPDGNRIQRDLYSAFLLQHYNSQSESFDQETLERDYPQFVRLHNQTIQRLSALPKTPSSMGIRRSVS

SEQ ID NO: 2608 - protein, 1134 aa, Unknown
  Description of Unknown: uncultivated organism sequence
  Category: MG81 effectors
  Description: MG81-897 effector
MKYVIGMDIGIGSIGWSVIRSDADCKRIEDFGVRIFEPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLRGSKAYEIDHIVPFSLILDNTLNNKALVLTSENQLKKQQTPLMYLSGERRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHSLSMPLISCKPERKYRGEITAANPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2609 - protein, 1138 aa, Unknown
  Description of Unknown: uncultivated organism sequence
  Category: MG81 effectors
  Description: MG81-898 effector
MKYVIGMDIGIGSIGWSVIRSDADCKRIEDFGVRIFEPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKTYEIDHIVPFSLILDNTLNNKALVLTSENQLKKQQTPLMYLSGERRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEVADHEGKDFKKPTYEEAEQAYRVSMENLYPTDLQFAHGLSMPLISCKPERKYRGKITADNPVKLREIDSKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKDKLRVQGIKRADIIPQNGKLCLAPWYKQPDGFFKHVMYLQKNDYLKVYENGELLFCGYYLSVEDIRNSKLYFIIDNQPGQNRKENCKSIHIKSEVKKYTVDILGKIGKKEIKCGEPLSSAKVKK

SEQ ID NO: 2610 - protein, 1136 aa, Unknown
  Description of Unknown: uncultivated organism sequence
  Category: MG81 effectors
  Description: MG81-899 effector
MKYVIGMDIGIGSIGWSVIRSDADCKRIEDFGVRIFDPGENAGDRKRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILKADGFDWETVCNIDTASDPDSILNRIGIIVSENITPARRKKALKNLNILNDDSITALCNYKFGGTSSVSYKYMSGAIEAFLNGDIYGKHQASHIEETATESIKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLGGSKAYEIDHIVPFSLILDNTLNNKALVLTSENQLKKQQTPLMYLSGERRKNFIGTVNELFRAKKINKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHGLSVPLISCKPERKYRGEITAANPVKLREIDGKLYTLSRKEIGKIERKDIEKIYTSDTQLIAYLIELFDGAKDTATLGDIMKEKSISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVCKNGKLSFCGYYRSAAGLTNSRLYFIIDNQPEDKKKYITLKLEVKKYSVDILGKIGKKEIKCGEPLSSAKVKK

SEQ ID NO: 2611 - protein, 495 aa, Unknown
  Description of Unknown: uncultivated organism sequence
  Category: MG81 effectors
  Description: MG81-900 effector
MPKEEKESCCVLQLRLYPEPWQVQIIETRFKVLEHLKNSLIALELRKLRNLEKTRAYREIQEQIKLADDKSKIKLYAKRRKLLKDAGFSEFVFKDDITPMQKHFAAHIATHVAHRAASEVWRAFDKFLFGNGKMVHYVRRGTLRSASNQTAGTTMTLENDYFKWKGGRDKNSIAINIRVAKPTTYYEKEMLQKKAKYFRIVRKWGKIGYKYYLQITLAGLPAVKPRLIANEKKVGIDIGPSSIAIVSDKKVELRALADKVQNNHIEKCSLQRSMDRSRRNLNPQNYNEDGTIRRGIRLNWTFSKHYIEMRGKVRMLERKNVDIRKYQHTCLANEVISLGTDVYIEQMSFKGLQRRAKETTYREDGRPKRKKRFGKSIANRAPAMFVEILGRKLTTIVGTELNKVDTFKFRASQYDHTNGSYKKKLLKERWAQLSNGDRIQRDLYSAFLLKNSNADLNSTNVEQCNATYDVFKIMHDDCITKLKSEKKSCLPSFGV

SEQ ID NO: 2612 - protein, 559 aa, Unknown
  Description of Unknown: uncultivated organism sequence
  Category: MG81 effectors
  Description: MG81-901 effector
MAKKISTDADTTLRAYKFRLDPTQAQASALAQCAGAARYAYNLLTAHNLDVSRARADYWHTRIDAGADETTVKAELKALAKSDAAYKSIGYAAYGTQHLTPEINRHRAASKAIESGADPAIVWPETERSSEPWMHTIPRRVLVSGLQSADKAWKNFFDSRTGVRAGRLVGTPRFKRKGVSRDSFTIPAPETIGAYGTAYLRGEPEYARRKAQLKRCGIKTTPTIEDYRHVRLSHLGVIRTHDTTRHLVKAVRAGAQVRSYTVSRAANRWYVSILVELTRPSASPTRAQRSAGAVGVDLGVRYLAALSDEQAPQRFAQYPSLEFTGDGAPTLANPRWARAAEKRLVRLQRALSRAQKGSNRRARIVQQIARHHHLVALRRESGLHQVSKRLSTGYTLIGLEDLAVAGMTASAAGTIEAPGKNVRQKAGLNRSILDAAFSTLRRQLEYKASWYGSQVQIIDRFFASSQMCSACGARAKTKLDLRVRVFECAACGVRIDRDVNAARNIRAEAVRMYEAQLAPGTGESLNGRGVTDSDAAGSVVLGDVALDASRPAASGGGSP

SEQ ID NO: 2613 - protein, 521 aa, Unknown
  Description of Unknown: uncultivated organism sequence
  Category: MG81 effectors
  Description: MG81-902 effector
MSTAAETSSAPQGTIERHVAFKFCLDPNQEQLVALGRDGGASRATYNMLVGYNTDVMKTRNKYWAKRREEGATDDEIKAELKTLTKEDPKFKALGYMAFAKNHLTPEIAHHRACAKAIEEGTPVEEVWGEGERSKEPWLHTVSRRVLVSGLMSADKALKNFFDSRTGKRAGGKMGAPKFKSRASNSDSFTIYAPDTMGGYGAPYLRGEPAYHDAKARMKRRGDKGTPTIGDYRHVRLAHLGTFRIHGNTRRMMRTIRKGGVIKSFTVSQVADRWYVSFLVEMTVPSPKSTRKQKKAGAVGVDLGVKYMAALSDTDAPKRFNPDSGVNFTDGTKPTIENPRWLKHAENRIAKLQQKIARQVKGSNRRTLNVRKLAKTHHIVALRRETGLHQLTKNLTTRYALIGIEDLNVAGMTASASGTVENPGKNVAQKAGLNRAVLDVAFGTFRSQLEYKSAWYGSAVQVIDRYYPSSQTCSNCGKRPDAKLTLNNRVYKCGHCHAVIDRDLNAAINIRREAERLHAEA

SEQ ID NO: 2614 - protein, 1134 aa, Unknown
  Description of Unknown: uncultivated organism sequence
  Category: MG81 effectors
  Description: MG81-903 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEEIVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKHGSPSAINIEVGSEVSRSFANRTADKNEQTKRMKEKDAAKKAIAELLGVDIASVTSKMIDRYFLGELQGWKCLYSGKEINKEECLRGSKAYEIDHIVPFSLILDNTLNNKALVLTSENQLKKQQTPLMYLSGEQRKNFIGTVNELFRAKKIKKKKYAYLLQPDLNDEKMSEWKSRNLNDMRHISRFMVGYLKENLKFDNFSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHGLSMPLISCKPERKYRGEITAANPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2615 - protein, 537 aa, Unknown
  Description of Unknown: uncultivated organism sequence
  Category: MG81 effectors
  Description: MG81-904 effector
MISDEEYKKLLKQYHKLSDRHILVVETDMPYSDVLKVVILSDKIRKAGNELVSFMRKNYDQLIRTKKYRKLLKLYGSTKDKKKRKDLADQLNEMQKAYNVTWDYCRKSMIPIGKKYGIDAVFALTKAEDVWRGIEKCLYGNGKAIHFSKYGELPCIRAKQINRGIPISVKDDRLQFKLGKTAFGIQVNDRFQQDEADAVLTYLAESEIVDNKAVNTLMEDAYYIDTYRPCYATLVIKMIRGRYRIYLHLTIEGKAKPKYDKYGNLRHKYGKGMIGADIGTQTVAYTSDTEVGLKNLSERGNSIQTSERKERLLYRAMDRSRRAANPQNYNEDGTVKKGRKTWKYSNHYKKLKAKHSELCRINAVNRQLAINEDANHLRSLGDTFVTEPKNASKLMKRAKETAVNDKGRFNKKKRFGKSIKNRCPSGFQTTVEKKFKTTGGTYIEVPNNYRASQYDHTVDDYIKKKLSDRLYKLQDGTEVQRDWYSSFLLYCYDYKIQNIDKNKCITKFDNCYKKEKALITWIKAHKIKVLNSGIKIA

SEQ ID NO: 2616 - protein, 567 aa, Unknown
  Description of Unknown: uncultivated organism sequence
  Category: MG81 effectors
  Description: MG81-905 effector
MTKRKKHQITEYEKCLREYHKASPRHVIVLETDLTEDEKRHLFHQADLLRQCGNELLGIMKRHLDQLLRTKKYRGLRKSYGKISKSIKSLQQIKELSNVQKRHLKDQKKNLQTVSDQMNEMQEEYHITWEYCRNTMKTLRLKYEQTSVIALSRAEDIWAAVSKVLYSDGERLHFKKRGDLPELRAKQFHKEIIGRVKNGSLEFRYGKVSLPVIRKETDLWLMDELEAVESYLKDPSFHDAYAIDQMKHGEIVSTYRPCYASIVCKTIRGKLRVYLHLTVEGLPFPKRTKDGVIKHLCGDGIVGCDIGTQTIAYTSDHVVGLENLAERGNSIRCVERQQRLVQRAMDRSRRAMNPDNYNADGTIRKGKKTWIKSKRYQKLQLSYRELCRVSAENRKLAIHEQVHKMRSLGDVFVTEAKNAKKLQKRANPEDPLNKNGKPKRKKRFGRSIQNRCPGYFQAKIQQLFESTGGTYIEVPSDYRASQYDHTVDDYIKKKLSQRMFNLKDGTKVQRDWYSSFLLYCIDLITKTIDRQKCLATFETQLNKEHAMIEEIIRLKKRIMNSGIRVAA

SEQ ID NO: 2617 - protein, 606 aa, Unknown
  Description of Unknown: uncultivated organism sequence
  Category: MG81 effectors
  Description: MG81-906 effector
MKPDHIHVFVDVPQTAATCDVVGTFKDISAIELFKAFPQLIQSYAGCGILWSRGYFVSTVIKIILRSRKMITDKGHKRHLKQFHKFSDRHILAIETDMPYSDIQKVVKLSNKIRKAGNELVGLMRKNYNQLMRTKRYRKLLFLYGDSKDKDKRRTYAKQLNEMQKAYNITWEYCRTSMIPIGKKYGVDAVFALTKAEDIWRGIEKCLYGNGNAIHFSRYGEMPCIRAKQINRGIPIFVRDNKLQFKLGRMVFGIQINDRFQQDEVDAVLSYLAESEILDDRAVSILIKDGYCIDTYRPCYATLVPRMIRGKYRVYLHLTIEGKAKQKYDKHGNPRHKYGKGMIGADIGTQTVAYTSDTEVGLKNLSERGNSIQTSERKERLLYRAMDRSRRATNPQNYNDDGTVKKSRKTWKYSNRYKKLKEKHSELCRINAINRQLAINEDANHLRSLGDVFITEPKNAGRLMRRAKETTVNSKGKFNRKKRFGRSIKNRCPSGFQAAVEQKFKVSGGTYIEVSNDYRASQYDHTVDDYIKKRLSDRMYKLQDGTEVQRDWYSSFLLHCYDYRTKDIDKNKCISEFDKCYSKEKALIEWIKANEIKVLNSGIKIA

SEQ ID NO: 2618 - protein, 519 aa, Unknown
  Description of Unknown: uncultivated organism sequence
  Category: MG81 effectors
  Description: MG81-907 effector
MIQPELKAYRRCSDRHVLVLETNLTYVEKCQFFHYADLIRKAGNELTGIMKKRYDQLVRTKRYRKLKSLYKKYKDADNKKALKDVCDQMKKMQKQYDVTWDYCRTSMIPIGKKYGIDAVFALTKAEDVFRGIEKCLYSDGETIHFKKRGDLPCIRAKQLNRGIIMKQMNFKFKNIEFGAKIKDRYEQEEVDAILYYLKNTELMDSIAANTYKETNICVSTYRPCYVSLVCKKIRGKLRVYVHITIEGLSKPKQDRFGNFKHNKGKGVVGCDIGTQTIAYTTETKAGLKNLAERGSCIEVNERKERRIYRAMDRSRRAMNPDNYNEDGTIKKGKKTWVLSNRYKKLRTKHTELCRINATNRHLAINEDVNELRSLGDVFVTEPKNAKKLQKKAKTGKRKKRFGRSIKNRCPGYFQSQAKRKFRIYVEVPNDYKASQYDHTSDEYVKKSLSQRMYKLQDGTMVQRDLYSSFLLYCIDLNTNKIDKNKCIHEFEKQYKNQNETIEYIQMNQIKVMNSGIRVN

SEQ ID NO: 2619 - protein, 1140 aa, Unknown
  Description of Unknown: uncultivated organism sequence
  Category: MG81 effectors
  Description: MG81-908 effector
MKYVIGMDIGIGSIGWSVIRSDADCKRIEDFGVRIFEPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKTYEIDHIVPFSLILDNTLNNKALVLTSENQLKKQQTPLMYLSGERRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRTSMENLYPTDLQFAHSLSMPLISCKPERKFSGKITADNPVKLREIDGKLYTLSKKRIYSAADKDKIKRTDIEKIYTSDANLIAYLIELFDGAKDTATLRDIMKENGISEIRTKNGNAIRKLTLRNICDKDFLKKEIDENNHTYLDTAKYYCVELYKDIKDKLRVQGIKRADIIPQNGKLCLAPWYKQPDNYFKHVMYLQKNDYLKVYKNGKLSFCGYYRSAAGLTNSKVHFIIDNQPEDKEKYITLKLEVKKYPVDILGKIGKKEIKCGEPLSSAKVKK

SEQ ID NO: 2620 - protein, 1134 aa, Unknown
  Description of Unknown: uncultivated organism sequence
  Category: MG81 effectors
  Description: MG81-909 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKAYEIDHIVPFSLILDNTLNNKALVLTSENQLKKQQTPLMYLSGERRKNFIGTVNELFRAKKIKKKKYAYLLQPDLNDEKMSEWKSRNLNDMRHISRFMVGYLKENLKFDNSSKSEGRWQNVYAVKGSLTSMFRKLWLNETTWGRADKASIKAETYLDHAVDAVVIGNCLPVYVEIAQINLRLRDIYKSNGRQFVAEYWDCFNKGVEMISCYYNIDKDTVRAFLKKSDRIPSLIPDLREEVDRRFVDHAIYSKYQKEIADHEGKKFKEPTYEEAEQAYRVSMENLYPTDLQFAHSLSMPLISCKPERKYRGEITAANPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2621 - protein, 1134 aa, Unknown
  Description of Unknown: uncultivated organism sequence
  Category: MG81 effectors
  Description: MG81-910 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEEIVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKAYEIDHIVPFSLILDNTLNNKALVLTSENQLKKQQTPLMYLSGERRKNFIGTVNELFRAKKIKKKKYAYLLQPDLNDEKMSEWKSRNLNDMRHISRFMVGYLKENLKFDNSSKSEGRWQNVYAVKGSLTSMFRKLWLNETTWGRADKASIKAETYLDHAVDAVVIGNCLPVYVEIAQINLRLRDIYKSNGRQFVAEYWDCFNKGVEMISCYYNIDKDTVRAFLKKSDRIPSLIPDLREEVDRRFVDHAIYSKYQKEIADHEGKKFKEPTYEEAEQAYRVSMENLYPTDLQFAHSLSMPLISCKPERKYRGEITAANPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVDLYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2622 - protein, 1134 aa, Unknown
  Description of Unknown: uncultivated organism sequence
  Category: MG81 effectors
  Description: MG81-911 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKTIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLGGSKAYEIDHIVPFSLILDNTLNNKALVLTSENQLKKQRTPLMYLSGERRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKDFEKPTYEEAEQAYRVSMENLYPTDLQFAHGLSMPLISCKPERKYRGEITAANPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYSVDILGKIGKKEIKCGEPLSSAKVKK

SEQ ID NO: 2623 - protein, 991 aa, Unknown
  Description of Unknown: uncultivated organism sequence
  Category: MG81 effectors
  Description: MG81-912 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEEIVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQIKRMKEKDAAKKTIAELLGVDIASVTSKMIDRYFLGELQGWKCLYSGKEINKEECLGGSKAYEIDHIVPFSLILDNTLNNKALVLTSENQLKKQRTPLMYLSGEQRKNFIGTVNELFRAKKIKKKKYAYLLQPDLNDEKMSEWKSRNLNDMRYISRFMVGYLKENLKFDNSSKLEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHGLSMPLISCKPERKYRGEITAANPVKLREIDGKLYTLSRKEIGKIERKDIEKIYTSDTQLIAYLIELFDGAKDTATLGDIMKEKKHLGNTNQERQRHSQTHFEKYMQQGFLKKRN

SEQ ID NO: 2624 - protein, 1312 aa, Unknown
  Description of Unknown: uncultivated organism sequence
  Category: MG81 effectors
  Description: MG81-913 effector
MKISKVNHVRTGTTVTQMQGEGIIYVNPSQNKNAKKDLTEHIKKLNEKAKVLYSPINPVNSITVSMDKNEKQDVNASAKAIKYLVNGILRKNENGIPDCDSLLSQIREKAREAHTSSINPDKLAEKIVDRCLRKKLCKKSEIAKALFAAILSSNKAERLNLLDKDEVKAFFDLAHEDYYKTEQLKEIEDSIVKKDVRVQVKEGMDGEKHLVLSSADNPKKHFYFDFIKEYTSKDNAGREEMLIRFRQLIILFYSGVKAYHLSIGSDVGAWTFGSSLPDVADNFNDEAAALITECQIQQAEKEKYGKKKNILSDKLKNCKYGTPEYRNLLGQETDCKTAIASCNSAIGNAQKKIKVLLADTICNNYRTAVKTEGLAEGDIFWIGYIQGIAEKLFEKKSSYTMYKMSTKYLYEVTFNEWLSFVALKVIDMGKAVYHFAMPDCSDICSGAEIRAGKVQPLFEDGITSFDYERIKAKETITREFAVHATYAAGIFSNAVADKEYRLHTETDEKGRTLNFEDPLQYKEKEWVQALVPDAKKKLLMFFGGQSGWDGTEIAAKSDLEVTSAFQEMINVIRNSNYHYAGSIVSPKEETITIMRGLFDKEFSELGRILREKYYSNNVPVYYGIGDIDKLMTFLYTGESKREAQIPSFGNIFKKKDIPDFVKKNIAGSLLAKYNVQELEKFRSALYFVLKEIYYYGFLKETNIKDRFLAFLNKSKNSAKNPDAYNSFQSRLKDLDADCSFGEICQMYMTDYNQQNQGNYKVKSQTQEEKDRKDDKGHKYEHFKMLLYVTIQGAFTDYLAEKKEIFSFLMAPDLKENFFGSNAAKGFISSWKADLFNETKKVLSEDAYVLSWYALAHLLSPKQLNHLQGDIKSYIQFVGEINAREKSVLGRERDTRLTDTTGDFEKILKVLEFVMNFVGKTSNVLTDYFADADDYAKHLYSYVSYAGKKEEKNNAALAAFCQKAITQKDITLTDKIGIYHDGINPIVNTNVVKAMMYGNETILSEAVSKVSGDLFHGDIVSYFRLKKELEKVFEKGECANREEQTKLREFQNLKNRVELYDIAVFTDIINDYMGELVNMAYLRERDLMYYQLGYHYLRQEYATVEEKYKTISEENICITSGALLYQIMAMYSYNLPIIYKGKEGTYKYSNGGKINKFVKNYCGENLEDYDNVYYSGLELFEQRSRHDELHQFRNDIDHLKYFISADKSILDMYSQVYNGFFSYDIKLKKSVSYIFTNILAKYFVTADIKLNAKQVDGKRAVKLSVSEMSSDSFSYKEKVKMRDGKERERAYYLPVRSEGFLKDTKKLVEYISK

SEQ ID NO: 2625 - protein, 537 aa, Unknown
  Description of Unknown: uncultivated organism sequence
  Category: MG81 effectors
  Description: MG81-914 effector
MISDKEYKKLLKQFHKLSDRHILVVETDMPSSDVQKVVILSDKIRKAGNELVGLMRKNYDQLMRTKKYRKLLKLYGSTNDKKKHRDLANQLNEMQKQYNVTWDHCRNAMIHIGKKYSIDAVFALTKAEDIWRGIEKCLYNNGKTIHFSKYGELPCIRAKQINRGISMSVKDNELKFKLKGNVFGIQVKDRFQTDEVCAVLEYLSRSEIINDKAINKFLDKAYCIDTYRPCYATLVPKFIRGKYRVYLHLTIEGKAKPKYDRFGNPRHKFGKGIIGADIGTQTVAYTSNTEVGLKNLSERGNSIQTSERRERLLYRAMDRSRRATDPQNYNDDGTVKKGRKTWKYSNHYKKLKAKHSELCRINAINRQLAINEDANHLRSLGDVFITEPKNASKLMKRTKDTTVNSKGKFHKKKRFGKSIKNRCPSGFQTTVERKFKVSGGIYIEVPNNYRASQYDHTADDYIKKKLSDRIYKLTDGTLVQRDWYSSFLLYCYDYRTKDIDKNKCISEFDKCYNKEKALIEWIKANKIKILNSGIKIS

SEQ ID NO: 2626 - protein, 1134 aa, Unknown
  Description of Unknown: uncultivated organism sequence
  Category: MG81 effectors
  Description: MG81-915 effector
MKYVIGMDIGIGSIGWSVIRSDADCKRIEDFGVRIFEPGENASDRKSNSQIRREYRSVRRVLRRRKHRKELLKAHLENICLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKSEQTKRMKEKDAAKKAIAELLGVDIASVTSKMIDRYFLGELQGWKCLYSGKEINKEECLRGSKAYEIDHIVPFSLILDNTLNNKALVLTSENQLKKQRTPLMYLSGEQRKNFIGTVNELFRAKKIKKKKYAYLLQPDLNDEKMSEWKSRNLNDMRHISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRTSMENLYPTDLQFAHGLSMPLISCKPERKYRGEITAANPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2627 - protein, 1289 aa, Unknown
  Description of Unknown: uncultivated organism sequence
  Category: MG81 effectors
  Description: MG81-916 effector
MKISKVDHVKTGVSERPIEAGGMMYSYPDSKNDNIVLREHIKKLTNRTKNLYLAFVAPKTNGGKLSMAAECSGTFNFYIKNNILCPIDNRKSDEEILNGILNAGFMARAIRDGRNERNVSENDVNNTVNRCLRQSLRKKYFSGSDGIYIPDVMKKLCMAIYGKANYKSIISSIPENELKLLIAAIRADYTRENYIEKIANSIEKQNVPIQVSEDGRRIILSSAYNEKKSYIFDFLKKYASCDKAGQEEMLKNMRYLIVLFFFGREVAEDALNDTGFCAWSFGLTLKEYGEKVFSKEVYDLWNARENIPFSQKADIRNLGDRLKLEYSKALVEHYQGALSSDDLSDSDKKWIGYISDKAGKMFSDHNMSSYKFTCGYLCERTWEEWISFVAMKFVEIGKGAYNFTMSAMDEIAKGGPVSFGTVDERYKNGISSFDYERMAAKDHLSRNLATYVSFALNNLDSSARSLDVREKAEDILSSSNLELLTNAKTKVLRYFGGESSFENMPVKDMSAEDIVSDLVSYFKVTRNSCFHFVSGASEGVNSDLFRAVFDKECQNAGVILRKRFYSNNVAMFYSEKDISALMTEMYDSVRNNPAQIPSFNKVISRNEVRNFITQLIPVGNRAPLNNAETSELFKNSIYFVLKEIYYHDFLNEKNLMKRFWDEIDSLKAADEKEEKAHEAFAARVKTITSENDDFGLLCQEIMTEYNQQNNQKSKKASAKKDKETGEIKKIENNDVIYKHYVMLLYLGIRQAFYKFIEEKECYAFLKKPSIGKQPEEKDFIYGWSTDMHNGMDVSDPLIQSWYITSHFINQKQLNHLIGQFKNYITYLDSIENRAEQTGNRIRESSKDQLDLYMKLLAVLDFAKLNNSLVSNTLEDYFDDADEYAKYISGFIDFGGDTKEALQAFCNQKFKCGDATETLGKYYDGLNPIMERNIILASMFGNTAIASNVIDRVTEKEVKDFYKRKNKVADLLSRGVSSEDDLKAIRFYQNLKNRIELVDMLSITELTNELVSHLTGYAYLRERDLMYMQLGYHYVKLFYTDVVDMSNKFRVLNGDCNITDGAALYQIAAMYSYDLPLYVIDDEGRSIKPNKLQSIGSKVKVFAKEYCKDDYDVYKEGLNLFEDISGPKDGRHDEFIDIRKYIDHMKYFANQKKSILDMYSEMYGGFFSYNTKLKKSVSYVLPNILMADFIVARLGFEKGIKTVGEKEVSVPQMVVKEISTDYLTFKEIKSILANQGNEILKDPNKIVIGSGWKEEPSQNNKGRKSEGTFVAARSTKYCEAVGRLLVYKKE

SEQ ID NO: 2628 - protein, 1134 aa, Unknown
  Description of Unknown: uncultivated organism sequence
  Category: MG81 effectors
  Description: MG81-917 effector
MKYVIGMDIGIGSIGWSVIRSDADCKRIEDFGVRIFEPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKTYEIDHIVPFSLILDNTLNNKALVLTSENQLKKQQTPLMYLSGERRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHGLSMPLISCKPERKYRGEITAANPVKLREIDGKLYTLSRKEIGKIERKDIEKIYTSDTQLIAYLIELFDGAKDTATLGDIMKEKSISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYSVDILGKIGKKEIKCGEPLSSAKVKK

SEQ ID NO: 2629 - protein, 1138 aa, Unknown
  Description of Unknown: uncultivated organism sequence
  Category: MG81 effectors
  Description: MG81-918 effector
MKYVIGMDIGIGSIGWSVIRSDADCKRIEDFGVRIFEPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNLVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKTYEIDHIVPFSLILDNTLNNKALVLTSENQLKKQQTPLMYLSGERRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEVADHEGKDFKKPTYEEAEQAYRVSMENLYPTDLQFAHGLSMPLISCKPERKYRGKITADNPVKLREIDSKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKDKLRVQGIKRADIIPQNGKLCLAPWYKQPDGFFKHVMYLQKNDYLKVYENGELLFCGYYLSVEDIRNSKLYFIIDNQPGQNRKENCKSIHIKSEVKKYTVDILGKIGKKEIKCGEPLSSAKVKK

SEQ ID NO: 2630 - protein, 1134 aa, Unknown
  Description of Unknown: uncultivated organism sequence
  Category: MG81 effectors
  Description: MG81-919 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEEIVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCMYSGKEINKEECLRGSKTYEIDHIVPFSLILDNTLNNKALVLTSENQLKKQQTPLMYLSGERRKNFIGTVNELFRAKKIKKKKYAYLLQPDLNDEKMSEWKSRNLNDMRHISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKKFKEPTYEEAEQAYRVSMENLYPTDLQFAHGLSMPLISCKPERKYRGEITAANPVKLREIDGKLYTLSRKEIGKIERKDIEKIYTSDTQLIAYLIELFDGAKDTATLGDIMKEKSISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYSVDILGKIGKKEIKCGEPLSSAKVKK

SEQ ID NO: 2631 - protein, 566 aa, Unknown
  Description of Unknown: uncultivated organism sequence
  Category: MG81 effectors
  Description: MG81-920 effector
MGWKSKGRGGTLVDNEEKKEDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWTQQENDDRKKSPKYQQRKKRQNYKGVKGIAREFPVVFSKNNPYEAEMLTKHVKFVRILRKDGKTKPHWYAQLVLEGRPVTKYDPISGAPKHPVGHGVVGIDIGTRTLAYSNDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 2632 - protein, 541 aa, Unknown
  Description of Unknown: uncultivated organism sequence
  Category: MG81 effectors
  Description: MG81-921 effector
MVQSTADAEAKSVMYRAYKFRLDPNNEQVKALYQAAGAARYTYNMMTAYNLEIKKNRDEFWYAHITEDSDEQYKKQVESQLKALEKAEPARYKPLCQYASFSTQKLTPAKHKHKEVSEAIAQGVLPNDAWGSEEHPKNPWLHEANQRVLVSGLQNSAKAWKNFWDSQTGRRKGAKVNLPRLKKRGISRDSFTVPAPEAMGGYGAPYKNDSEQYKRLKKKGKDAVIQDYRHVRLSYLGVLRTFNSTKPLAKAVNTGAKIKSYTVSRNADRWYVSFLVELSEPIARPATKKQRAAGGVGIDLGVKTLVTLSDESNPYIANLRPGQRAQRKLRKLQQKFARSQKGSNRRARLAAEIARLHHKVALRRKGYLDQVTKGLVTQYSAVACEDLNVSGMVHSAKGTVENPGKNVAAKSGLNRSILDASFGMFIRQLEYKSAWYGSVVLKVDKWFPSSRTCFNCGEVKSKLPLSERVYDCQYCGYSADRDLNAARNILEQAYKEKEDKQNPQFAPERGENSNGRGRGSTCSVESGETSRPADGSAGHRR

SEQ ID NO: 2633 - protein, 508 aa, Unknown
  Description of Unknown: uncultivated organism sequence
  Category: MG81 effectors
  Description: MG81-922 effector
MKRHLDQLLRTKKYRGLRKSYGKISKSIKSLQQIKELSNVQKRHLKDQKKNLQTVSDQMNEMQETYHVTWEYCRNTMKTLRLKYEQTSVIALSRAEDIWTAVSKVLYSDGERLHFKKRGDLPELRAKQFHKEIIGRVKNGFLEFRYGKVSLPVIRKETDLWLMNELEAVESYLKDPDFHDAYAINQMQQGEIVSTYRPCYASIVCKTIRGKLRVYLHLTVEGLPFSKRTNDGIIKHPYGNGPVGCDIGTQTIAYTSDHTVGLENLAERGNSICYVERWQRLVQRAMDRSRRAMNPDNYNDDGTIRKGKKTWIKSKRYQKLQLRYRELCRISAENRRLAIHEQVHKMRSLGDIFVTEAKNAKKLQKRANPENPLDKNGRPKRKKRFGRSIQNRCPGYFQAKVKQLFESTGGTYIEVPSDYRASQYDHTVDDYIKKKLSQRMYNLKDGTKVQRDWYSSFLLYCIDLITKTIDRQKCLATFETQLNKEHAMIEEIIHLKKHIMNSGIRVAV

SEQ ID NO: 2634 - protein, 1323 aa, Unknown
  Description of Unknown: uncultivated organism sequence
  Category: MG81 effectors
  Description: MG81-923 effector
MKVSKVDHTSAGVTSKKDITYNGLLYRNPPKKGVNEILKDAETDEKILENMENYITRLNNRASSLYSVFNPIGNEKSKDNKSAEKDLYRNISSCFRDFVQDIKSNSADTASRNLLNRSFRVNSDKETIDNFVARYLRKSLQKRVNGYELSEIIRNIIYLKANLYRKEDVPVKEVCILAEAIKEDITKERQIKKMAVSIVKQDVKIQTYLSDDGKVLLRHTFAKHSKKSALFRFLQKFTSADIEEQEEMIRELRALVVLFYCGPNAYKEAQGDGIGVWTFGKTASDVRVNFCEEACRLITEYQAELERVETEKKEKSSNVKPVNTDIYKEKIKKAIRYSIAGSYQEAARTLKETEGFEDKRLWLGLIEEYAERILLSNRRFMDPGTQNCEFLCKRTMQMLISYIAMKLVDLGKAVYHFAMPAQIDVTNGKPAEFGEVQPSFRDGITSFDYEWIKAEESLTRELSTYSVFAVRNFLNSISKKESDIIAVNLNDVESGNLKSNSVMRVLRYFGGKKEWQDTYIGEVSENELINALRKEIGAARNSTFHYAGTIDNGITDDDKLIISQIYEKEHGDIGRIRRKKYYSNNALMFYKKTDIDALMDYLYSAPKDHPAQIPAFSKILNKNKVYEFSKFIKGNPKKKISTAGKTEELKGCVFYMLKECYYYGFLPDSRSALFVREALEDIVKSAEDAGPAATDRRLEAAQNFKKRFYEISEKASLGQICQRIMTDFQLQNGGQKKVQSSKYAKKGVGEPIYQHFRMMLYDILRKAFWKYLNTLTETGEMNFMFMREPSYKPEFATEEEFCKNWNDHSYDDIREGMEEDSYLEAWFTAAHFIAPAQLNHLIGSFKKYEQFTSDIKFRAEGNGIECNSRWQNRIHQDEMHRLLRVLEFVQMTNGTFSKEISDYYGRDVDSAIEEYAEFVENFVDFSTKKMPNKHVALQTFCNIAVKSGSPNGRIGIYYDGEKPILNRNIVMADMYGNVSLISNCMKKVTEREIKVFYNDMNNLTEVFKRGVCQNEDEQKRLKAFQNNKNRVELLDVAIYTEIVNELYAQLVSWSYLRERDLMYYQLGVNYMKLFNGNSVPKDSFLRIIQGNGANITEGAVLYQLVAMNSFGWPLLCRDGSADKKANTTGQKVDSFFKDYCRKDASIYESCLMLFERLQSHDAIIKEIRNPIDHMYYFEKGKNGATKSILEMYGDIYDRFFDYDLKLKKSVSFVLQNILLDHFIIAHTVMNRQEEKYKYKNKDGQEKSYTGTKLAIRPNREQKKKVFDKTIRKMKEISIIHYGMESDVLTYKIKVDSMPVLVIVDARSRMFLDQMQRILEYSKT

SEQ ID NO: 2635 - protein, 1134 aa, Unknown
  Description of Unknown: uncultivated organism sequence
  Category: MG81 effectors
  Description: MG81-924 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDKNGCFVFDSALAHDLIASALKNAKFTKSDFNKICKAHGIVPIYGGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESKKVINAIIEKYGSPSAINIEVGSEVSRSFANRTADKNEQTKRMKEKDAAKKAIAELLGVDIANVTSKMIDRYFLGELQGWKCMYSGKEINKEECLRGSKAYEIDHIVPFSLILDNTLNNKALVLTSENQLKKQQTPLMYLSGERRKNFIGTVNELFRAKKIKKKKYAYLLQPDLNDEKMSEWKSRNLNDMRHISRFMVGYLKENLKFDNSSKLEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSMIPDLREEVDRRFVDHAIYSKYQKEIADHEGKKFKEPTYEEAEQAYRTSMENLYPTDLQFAHSLSMPLISCKPERKFSGKITADNPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYPVDILGKIGKKEIKCGEPLSSAKVKK

SEQ ID NO: 2636 - protein, 537 aa, Unknown
  Description of Unknown: uncultivated organism sequence
  Category: MG81 effectors
  Description: MG81-925 effector
MITDKEHKRHLKQFHKLSDRHILAVETDMSYSDVLKVVALSDKIRKAGNELIGIMRKNYNQLMRTKRYRKLLFLYGNSKDKNKRKTYAKQLNEMQKAYNITWEYCRTSMIPIGKKYGVDAVFALTKAEDIWRGMEKCLYGNGNILHFSRYGELPCIRAKQMNRGIRIFVKDNMLQFKLGRMVFGIQTNDRFQQDEVDAVLSYLAESEILNDRAVNTLIKDDYCIDTYRPCYATLVPKMIRGKYRVYLHLTIEGRAKPKYDRFGNPRHKYGKGMIGADIGTQTVAYTSDTEVGLKNLSERGNSIQTSERKERLLYRAMDRSRRATNPQNYNDDGTVKKGRKTWIYSNHYKKLKEKHSELCRINAINRQLAINEDANHLRSLGDLFITEPKNAGKLMRRAKETTVNCKGKFNRKKRFGKSIKNRCPSGFQAAVEQKFKVSGGIYIEVSNDYRASQYDHTIDEYIKKKLSDRMYKLQDGTEVQRDWYSSFLLYCYDYRTKDIDKNKCISEFDKCYNKEKALIEWIKVNEIKVLNSGIKIA

SEQ ID NO: 2637 - protein, 1138 aa, Unknown
  Description of Unknown: uncultivated organism sequence
  Category: MG81 effectors
  Description: MG81-926 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGSEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYVGKGKDTDISRCFKFLKAIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKSEQTKRMKEKDAAKKAIAELLGVDIASVTSKMIDRYFLGELQGWKCLYSGKEINKEECLRGSKAYEIDHIVPFSLILDNTLNNKALVLTSENQLKKQQTPLMYLSGERRKNFIGTVNELFRAKKIKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEVADHEGKDFKKPTYEEAEQAYRVSMENLYPTDLQFAHGLSMPLISCKPERKYRGKITADNPVKLREIDSKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKDKLRVQGIKRADIIPQNGKLCLAPWYKQPDGFFKHVMYLQKNDYLKVYENGELLFCGYYLSVEDIRNSKLYFIIDNQPGQNRKENCKSIHIKSEVKKYTVDILGKIGKKEIKCGEPLSSAKVKK

SEQ ID NO: 2638 - protein, 1146 aa, Unknown
  Description of Unknown: uncultivated organism sequence
  Category: MG81 effectors
  Description: MG81-927 effector
MKYVIGMDIGIGSIGWSVIRSDADCKRIEDFGVRIFDPGENAGDRKRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEKSEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKAIKPILKADGFDWETVCNIDTASDPDSILNRIGIIVSENITPARRKKALKNLNILNDDSITALCNYKFGGTSSVSYKYMSGAIEAFLNGDIYGKHQASHIEETATESIKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLGGSKAYEIDHIVPFSLILDNTLNNKALVLTSENQLKKQQTPLMYLSGERRKNFIGTVNELFRAKKINKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTIRAFLKKSDRIPSLIPDLREEVDRRFVDHAIYSKYQKEIADHEGKKFKEPTYEEAEQAYRVSMENLYPTDLQFAHGLSMPLISCKPERKYRGEITAANPVKLREIDGKLYTLSKKRIYSAADKDKIKRTDIEKIYTSDANLIAYLIELFDGAKDTATLRDIMKEKGISEIRTKNGNAIRKLTLRNICNKDFLKKEIDENNHTYLDTAKYYCVELYKDIKDKLRVQGIKRADIILQNGKLCLAPWYKQPDGYFKHVMYLQKNDYLKVYENGELLFCGYYLSVEDIGNSKLYFIIDNQPGQNKKENCKSIHIKSEVKKYTVDILGKIGKKEIKCGEPLSSAKVKK

SEQ ID NO: 2639 - protein, 974 aa, Unknown
  Description of Unknown: uncultivated organism sequence
  Category: MG81 effectors
  Description: MG81-928 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGSARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPAWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEGEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRGTRPHQGPPARGDPARHTRGTAARRGDAARAVRAQGRGQADGGRPGQDQGRRPLPGRGGGPAPLAECGQARGCPAPLGTWRHHPACARLRRRVQQRRGAATGIGTGPSQQRRHGAHGHLQP

SEQ ID NO: 2640 - protein, 1098 aa, Unknown
  Description of Unknown: uncultivated organism sequence
  Category: MG81 effectors
  Description: MG81-929 effector
MQVRDDVILGLDIGVGSLGWALLEEDLQTGEQRLLQRQAPQGETSYALGVRLFNVPENPKTKELLNVKRRTARMQRRTTARRAQRMRRVRALLDSLGVPGVRDADAFHLGKGRGAQYDPWQLRREGLERRLEAREWAVVLLHIAKHRGFRSNSKTDSSGSDKEMGQVLQAVSNLQQEVEASGLTVGALLASRERRRNRADHTGAPRYDLCMLRSLQEDEVNILFTRQRELGNPLAGEDIRCRYAELAFAQRPLAPVSHMVGPCAFLEGERRAPRFAPTAELFRYVQALCTMRLRQETGEETPLSEEQRQAACAVFGSVQSVTYKKLRQVLRLPAGCRFVGLSYGVTGKGKVQDPEKADVVMRTGKCCQGTACLRGILGDAYDALHEQRLDEADAARLAATDALSAPAAALLARGMAGLRLTDALVRIVSELNDLGQIRAILALLPLPAPRIAALSQAAGEGKLGFFQGTARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPEAVSAGEVQRYELWRQQDGKCAYYMLWRHAGGERAYGNAMPQGSIPPAWLADGVNAVQVDHILPRSRTFDNSFHNLCLCCHAANQAKGGRTPWEWLGAAQPQAWHDFEQWVQSLPLKGLKKRNYLLRDLSAEVQGRFHARNLTDSSYVARLTLRWLEEEYARHDVPMQDAEGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDRIKDAARCPDVVAALRRWLDAGKPGDDLPRSAHGDIIRHVRVRAGEFSSGVILQRGSGQAQAKNGGIVRTDIYSRDGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRP

SEQ ID NO: 2641 - protein, 1098 aa, Unknown
  Description of Unknown: uncultivated organism sequence
  Category: MG81 effectors
  Description: MG81-930 effector
MQVRDDVILGLDIGVGSLGWALLEEDLQTGEQRLLQRQAPQGETSYALGVRLFNVPENPKTKELLNVKRRTARMQRRTTARRAQRMRRVRALLDSLGVLGVRDADAFHLGKGRGAQCDPWQLRREGLERRLEAREWAVVLLHIAKHRGFRSNSKTDSSGSDKEMGQVLQAVSNLQQEVEASGLTVGALLASRERRRNRADHTGAPRYDLCMLRSLQEDEVNILFTRQRELGNPLAGEDIRCRYAELAFAQRPLAPVSHMVGPCAFLEGERRAPRFAPTAELFRYVQALCTMRLRQETGEETPLSEEQRQAACAVFGSVQSVTYKKLRQVLRLPAGCRFVGLSYGVTEKGKVQDPEKADVVMRTGKCCQGTACLRGILGDAYDALHEQRLDEADAARLAATDALSAPAAALLARGMAGLRLTDALVRIVSELNDLGQIRAILALLPLPAPRIAALSQAAGEGKLGFFQGTARLSLRAMEAILPHMQACGEYAAACELAGFDPRAAQKTDLTDIRNPVVLRVFREVRRQFSAICREFGFLPGRVHVELLREVGKSGEERNRISRGLERRTKEKEAARKAVAQLLGKSPEAVSAGEVQRYELWRQQDGKCAYYMLWRHAGGERAYGNAMPQGSIPPAWLADGVNAVQVDHILPRSRTFDNSFHNLCLCCHAANQAKGGRTPWEWLGAAQPQAWHDFEQWVQSLPLKGLKKRNYLLRDLSAEVQGRFHARNLTDSSYVARLTLRWLEEEYARHDVPMQDAEGRTRRRFFARPGQVTDFLRRHWGVQALKKIDGQRSGDRHHALDALLVAACSEGMLQRMVRAFQREENGPERLHIPCPWQDFSTTVGRALGSVFVSRVERGRTKGPLHEETLRAIREERQPDGETRRVLYERKAVARLTVADLDRIKDAARCPDVVAALRRWLDAGKPGDDLPRSAHGDIIRHVRVRAGEFSSGVILQRGSGQAQAKNGGIVRTDIYSRDGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRP

SEQ ID NO: 2642 - protein, 605 aa, Unknown
  Description of Unknown: uncultivated organism sequence
  Category: MG81 effectors
  Description: MG81-931 effector
MPDHINVFVDVPQTAAPCDVAGTFKDMSAIELFKAFPQLIQFYAGYCVLWSRGYFVSTVIKIILRSRKMITDKEHKRHLKQFHKFSDRHILAVETDMPYSDVLKVVALSDKIRKAGNELVGLMRKNYDQLMRTKRYRKLLFLYGNTKDKDKRKTYAKQLNEMQKAYNITWEYCRTSMIPIGKKYGVDAVFALTKAEDIWRGMEKCLYGNGNAIHFSKYGELPCIRAKQMNRGIPISVTDNKLHFKLGRMVFGIQTNDRFQQDEVDAVLSYLAESEILDDKAVNTLIKDGCCIDTYRPCYATLVPRMIRGKYRVYLHLTIEGKAKPKYDKHGNPRHKLGKGMIGADIGTQTVAYTSDTKVGLKNLSERGSSIQTSERKERLLYRAMDRSRRATNPQNYNDDGTVKKGRKTWIYSNHYKKLKTKYSELCRINAINRQLAINEDANHLRSLGDVFITEPKNAGKLMRRAKETTVNSKGKFNRKKRFGKSIKNRCPSGFQSAVEQKFKVSGGIYIEVSNDYRASQYDHTIDDYIKKKLSDRMYKLQDGTEVQRDWYSSFLLYCYDYRTKDIDKSKCISEFDKCYNKEKALIEWIKVNEIKVLNSGIKIA

SEQ ID NO: 2643 - protein, 501 aa, Unknown
  Description of Unknown: uncultivated organism sequence
  Category: MG81 effectors
  Description: MG81-932 effector
MNEGDGMPKEEKESCCVLQLRLYPEPWQVQIIETRFKVLEHLKNSLIALELRKLRNLERTRAYREIQEQIKLADDKSKIKLYAKRRKLLKDAGFSEFVFKDDITPMQKHFAAHIATHVAHRAASEVWRAFDKFLFGNGKMVHYVRRGTLRSASNQTAGTTMTLENGYFKWNGGRDQNSIAINIRVAKPTTYYEKEMLQKKAKYFRIVRKWGKIGYKYYLQITLAGLPAVKPRLIANEKKVGIDIGPSSIAIVSDKKVELRALADKVQNNHIEKCSLQRSMDRSRRNLNPQNYNEDGTIRRGIRLNWTFSKHYIEMRGKVRMLERKNVDIRKYQHTCLANEVILLGTDVYIEQMSFKGLQRRAKETTYREDGRPKRKKRFGKSIANRAPAMFVEILGRKLTTIVGTELNKVDTFKFRASQYDHTNGSYKKKLLKERWAQLSNGDRIQRDLYSAFLLKNSNADLNSTNVEQCNATYDAFKIMHDDCITKLKSEKKSCLPSFGV

SEQ ID NO: 2644 - protein, 567 aa, Unknown
  Description of Unknown: uncultivated organism sequence
  Category: MG81 effectors
  Description: MG81-933 effector
MTKRKKHQITEYEKCLREYHKASPRHVIVLETDLTEDEKRHLFHQADLLRQCGNELLGIMKRHLDQLLRTKKYRGLRKSYGKISKSIKSLQQIKELSNVQKRHLKDQKKNLQTVSDQMNEMQEEYHITWEYCRNTMKTLRLKYEQTSVIALSRAEDIWTAVSKVLYSDGERLHFKKRGDLSELRAKQFHKEIIGRVKNGSLEFRYGKVSLPVIRKETDLWLMDELEAVESYLKDPSFHDAYAIDQMKHGEIVSTYRPCYASIVCKTIRGKLRVYLHLTVEGLPFPKRTKDGVIKHLCGDGIVGCDIGTQTIAYTSDHVVGLENLAERGNSIRCVERQQRLVQRAMDRSRRAMNPDNYNADGTIRKGKKTWIKSKRYQKLQLSYRELCRVSAENRKLAIHEQVHKMRSLGDVFVTEAKNAKKLQKRANPEDPLNKNGKPKRKKRFGRSIQNRCPGYFQAKIQQLFESTGGTYIEVPSDYRASQYDHTVDDYIKKKLSQRMFNLKDGTKVQRDWYSSFLLYCIDLITKTIDRQKCLATFETQLNKEHAMIEEIIRLKKRIMNSGIRVAA

SEQ ID NO: 2645 - protein, 1098 aa, Unknown
  Description of Unknown: uncultivated organism sequence
  Category: MG81 effectors
  Description: MG81-934 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGTARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPAWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVVLQRGSGQAQASNGGMVRTDIYSRDGKFYMVPVYAKDVADKRLPLRACVAHKDEKDWPEMTADYRFLFSLTPDCYVLTENRKGEIKEGYFSGADRSSANISLTLAHDRKSSIRGIGIQKLRRFEKYRVDRFGRLSPVRREADPRGRS

SEQ ID NO: 2646 - protein, 441 aa, Unknown
  Description of Unknown: uncultivated organism sequence
  Category: MG81 effectors
  Description: MG81-935 effector
MDADEYKKLLKKFHKLSDRHILVAETDMSYPDVQKVVNFSGRIRKAGNELVGVMKKNYEQLMRTKKYRKMLQLYGSTEDKNKRKTYAGQLNEMQEQYNVTWDFCRVSMIPIGKKYGIDAIFALAKAEDVWRGVEKCLYGNGRMLHFSRYGDFPCIRAKQINRGVPMSVKNDELKFKLGKLVFGIQVKDRFQTDEVNAVLDYLAQPEVIDNKAVKTLQDEACCISTYRPCYATLVPKFIRGKYRVYLHLVIEGKAKPKYDSSGNPRHKYGRGVVGADIGTQTIAYTSDTETGLKNLSERGNSIQKSERLERLYYRAMDRSRRATNPKNYNADGTIKKGKKKWTYSRHYKKLKAKHAELCCINATNRQLAINEDVNHLRCLGDTFVTEPKNAARLMKRSKDTTVNNKGKINRKKRFGKSVKNRCRAVSRLPWKISSKHPAVHT

SEQ ID NO: 2647 - protein, 1098 aa, Unknown
  Description of Unknown: uncultivated organism sequence
  Category: MG81 effectors
  Description: MG81-936 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGSARLSLRAMEAILPHMLACGEYAAACELAGFDPRAAQKADVTDIRNPVVLRVFREVRRQFSAICREFGFLPGRVHVELLREVGKSGEERNRISRGLERRTKEKEAARKAVAQLLGKSPEAVSAGEVQRYELWRQQDGKCAYYMLWRHAGGERAYGNAMPQGSIPPAWLADGVNAVQVDHILPRSRTFDNSFHNLCLCCHAANQAKGGRTPWEWLGAAQPQAWHDFEQWVQSLPLKGLKKRNYLLRDLSAEVQGRFHARNLTDSSYVARLTLRWLEEEYARHDVPMQDAEGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDRIKDAARCPDVVAALRRWLDAGKPGDALPRSAHGDIIRHVRVCAGEFSSGVVLQRGSGQAQASNGGMVRTDIYSRDGKFYMVPVYAKDVADRRLPLRACVAAKAEKDWREMTADYRFLFSLTPDCYVLTENRKGEVKEGYFIGSDRSTAAISLSLAHDRQQSLRGIGITTLKRFEKYRVDRFGRLSSVRREADPRGRS

SEQ ID NO: 2648 - protein, 1098 aa, Unknown
  Description of Unknown: uncultivated organism sequence
  Category: MG81 effectors
  Description: MG81-937 effector
MQVRDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALAQAAGEGKLGIFQGSARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPDWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDDLPRSAHGDIIRHVRVRAGEFSSGVILQRGSGQAQAKNGGIVRTDIYSRDGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRS

SEQ ID NO: 2649 - protein, 1098 aa, Unknown
  Description of Unknown: uncultivated organism sequence
  Category: MG81 effectors
  Description: MG81-938 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGSARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPAWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVVLQRGSGQAQASNGGMVRTDIYSRDGKFYMVPVYAKDVADKRLPLRACVAHKDEKDWPEMTADYRFLFSLTPDCYVLTENRKGEIKEGYFSGADRSSANISLTLAHDRKSSIRGIGIQKLRRFEKYRVDRFGRLSPVRREADPRGRS

SEQ ID NO: 2650 - protein, 1098 aa, Unknown
  Description of Unknown: uncultivated organism sequence
  Category: MG81 effectors
  Description: MG81-939 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGSARLSLRAMEAILPHMLACGEYAAACELAGFDPRAAQKTDVTDIRNPVVLRVFREVRRQLSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPAWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVVLQRGSGQAQASNGGMVRTDIYSRDGKFYMVPVYAKDVADKRLPLRACVAHKDEKDWPEMTADYRFLFSLTPDCYVLTENRKGEIKEGYFSGADRSSANISLTLAHDRKSSIRGIGIQKLRRFEKYRVDRFGRLSPVRREADPRGRS

SEQ ID NO: 2651 - protein, 1132 aa, Unknown
  Description of Unknown: uncultivated organism sequence
  Category: MG81 effectors
  Description: MG81-940 effector
MKYVIGMDIGIGSIGWSVIRSDADCKRIEDFGVRIFDPGENASDRKSNSQIRREYRSVRRVLRRRKHRKELLKAHLENIGLTTIDRINEYFKHADGDIISLRVKGLDKKLAPEEIAACLINIANRRGYRPFYENEELSQYEKTSLNKTRQFMLSGEYRTSAEMILKNEQFDSEESEYRSYRNRSGNEETVLIERKWLRDEVEKILKKQSEFYPCLNDRNTNAIKRIIFDQRDFEDGPGDKNDPFRRYTGFLESMGQCRFYPDEKRGYRATLTADTYSLVNELSQYSYVDENGCFVFDSALAHDLIASALKNAKFTKSDFNKICKAHGIVPIYGGKGKDTDISRCFKFLKTIKPILEADGFDWETVCNIDTASDPDSILNRIGIIVSENITPARRKKALKNLNILNDDSITALCNYKFGGTSSVSYKYMSGAIEAFLNGDIYGKHQASHIEETATESVKHTKLPVFDKDFEFFKNPVVFRAINESRKVINAIIEKYGSPSAINIEVGSEVSRSFANRTADKNEQTKRMKEKDAAKKAIAELLGVDIASVTSKMIDRYFLGELQGWKCLYSGKEINKEECLGGSKAYEIDHIVPFSLILDNTLNNKALVLTSENQLKKQRTPLMYLSGERRKNFIGTVNELFRAKKKKKYAYLLQPDLNDEKMSEWKSRNLNDMRYISRFMVGYLKENLKFDNSSKSEGRWQNVYAVKGSLTSMFRKLWLNETTWGRADKASIKAETYLDHAVDAVVIGNCLPVYVEIAQVNLRLRDIYKSNGRQFVAEYWDCFNKGVEMISRYYNIDKDTVRAFLKKSDRIPSLIPDLREEVDRRFVDHAIYSKYQKEIADHEGKDFEKPTYEEAEQAYRVSMENLYPTDLQFAHGLSMPLISCKPERKYRGEITAANPVKLREIDGKLYTLSKKEIGKIERKDIEKIYTSDTQLIAYLIELFDGAKDTATLGDIMKEKGISEIRTKNGNAIRKLTLRNICNKDFLKKEIDENNHTYLDTAKYYCVELYKDIKNQLQVQGIKRADIILQNGKLCLAPWYKQPDDYFKHVMYLQKNDYLKVYKNGKLSFCGYYRSAAGLTNSRLYFIIDNQPEDKKKYITLKLEVKKYSVDILGKIGKKEIKCGEPLSSAKVKK

SEQ ID NO: 2652 - protein, 512 aa, Unknown
  Description of Unknown: uncultivated organism sequence
  Category: MG81 effectors
  Description: MG81-941 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYQASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 2653 - protein, 512 aa, Unknown
  Description of Unknown: uncultivated organism sequence
  Category: MG81 effectors
  Description: MG81-942 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRVKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERRNISSYGIA

SEQ ID NO: 2654 - protein, 512 aa, Unknown; identical to SEQ ID NO: 1750
  Description of Unknown: uncultivated organism sequence
  Category: MG81 effectors
  Description: MG81-943 effector

SEQ ID NO: 2655 - protein, 622 aa, Unknown
  Description of Unknown: uncultivated organism sequence
  Category: MG82 effectors
  Description: MG82-1 effector
MAVVVHVYGVPPVLHGERVRLPAEVDEQLSLAHCLREDLVTLEHQRQDAVTAVWSSYPQIAAIETQLTAAETELTDRSAAAAAERSAARKKGPTESSEAVRQLKARIKDLRSQRRTAIADAHPTATPRLTAIADAHRAAIKALYADYSQGRGLYWATYNDVVAHHQVATKRVAAERKAGRPANIRHHRYDGSGSITVQLQRQTGAPPRLPATIADEQNGPWRNVLYLTPWVDPDTWATLARAEQRRRRLGVVRLDLGNKRHLSIPVLVHRMLPADADITSARLVVRRVAGHRKIELHVTARIKDPVTRSGGPAVALHLGWRREDGGAVRVATWRSTAPVHVPDDLNDLVHADTDHTGTISLPARWWHRVSTQPEMAARRATSLNDIRDQLVAALTDNPLTITADDEDAQPVPTAAAVATWRSPARFAHLARTWATDCPAGHQATAAALENWRRSDRRLWEQQAHGTANTLAARADAYRRTMSWLLTGASRLVLDNTAIADLARRADPATEPTLPTAVTDRVAHQRIGASPGQLRSIATTTANSYGVAVAVMPHTGITRTHYRCGHLNPADDRYSAARIVTCDGCGQHYDQESSATLMLLAASGDVAAPGSATARNPDTSAHA

SEQ ID NO: 2656 - protein, 629 aa, Unknown
  Description of Unknown: uncultivated organism sequence
  Category: MG82 effectors
  Description: MG82-2 effector
MSAAPQERRSARGPDVPQRRASTDPTILVAGEADASPEDSVTVHTMGVHYRWELPKVVRAQLRLAHDLREDLVTLQLDYEQDVRAIWSSYPDVAAAESELQRADDAVAAVNEHISAERVRLRSKKVGADLTKQLAAARAAVKAARQARRDAIAAVRDAAAQRLRARAAALLAGQKLLYRRYCQDNDLYWASYNDVFRHHKTALQRIRRQRLEGKPATLRHHRFDGTGTITVQLQRTAAMPARSPLLLSDPQGRYRNFLVLPWIDPDYWASLTRAQQRAAGRVVVRMRAGTVDGQPQWIDIPVQAHRWLPADAEILNARLTIDRVAARLSTRLNITARIGAPAAADGLAVAVHLGWRDSDRGTRVATWRSTQPLDVADELSDVMLTDDGLTGSIVLPPTISRRLERHAVTAAARAQSFNAVRDKLVSWLDEHGPMAYRDSDISAAEVRRWRSPARLAAVAIAWRDDHTRGEIVAVLEQWRSADRKIWDGQEHGRRRALGYRNDLYRQVGALLASQAARVVVDDINIAAIAGSRRARNDAPAGLQQLIDRRRFHAAPSRLRTAITAAAHRGGLRVDVVAAKGLSRVHAQCGHENPADDRYVSPPVTCEGCGMAYDPNESATLLMLRAVDAL

SEQ ID NO: 2657 - protein, 610 aa, Unknown
  Description of Unknown: uncultivated organism sequence
  Category: MG82 effectors
  Description: MG82-3 effector
MWCVVRVDRLRVTPGNAGFRLLGHARGTPGPSGSARRPGSVGPPVAGAMTAAETVVGAVTVHTMGVHYRWLLPEVLRAQLRLSHSLREDLVTLQLAYEADLRDIWSSYPLVTAAETVLRQAEQAAASATEQVKSERIRLRSKTVSAELTARLSEARDAVTAARQTRRDAIASVKDAAAHRRRDRTALLRADQKQLYRHYCQDDDLYWGTYNDVVHNHRTAVARIQRRRLDGKPAVLRHHRFDGTGTITVQLQRSAAMPPRRPELLCDPAGRYHNHLVLPWIDPRRWTEMSRSEQRRAGRVSVRMRAGSLDGQPQWIDIPVQAHRWLPADAEILTAKLAVTRVAARLSARLIITARIQPPATTPDGPTVAIRLGWRDSVHGTRVASWRSTQPLAIPGRLAHVIAADDRGLTGIITVPQSISQRLERHATTAAARDTALNAIRDKLTSWLHEHGPLPYRDGHLSADEVRRWRSPRPIRGLGHRLARRSPARRHRRRPRGVARRRPQTMGWARTRPPPSAGTPRRSLPPGRRPAHRTGRPGGGRRHQHLRHCPLAPRPRRRGGKSAAGHRPPPLSGRAGQTPRRHRRCGPAHQHSARGHLGQGAVANPCRLWP

SEQ ID NO: 2658 - protein, 390 aa, Unknown
  Description of Unknown: uncultivated organism sequence
  Category: MG83 effectors
  Description: MG83-1 effector
MARSRTYKFLLQPTSQQLAAFECLLRLQRELYNAALEERRGTWKWNQRSVSYFDQTKELTQLRSVRPDILSFGVTVCRGTLMRLDRAFNGFFRRCKSGESPGFPRFKGPGSFVSLQWLDTNGWALDETAGRLRLYGIGNVKAHLHRPIKGTPKTITIRREGRRYWVSIQCVDVPAEPLPATGKSIGIDLGVDFLVATSDGQLIQAPRFGKRGHAGLEKAQRDLATKIPGSKNREKAKQRVATHHRKIANRRRDFAHQTSRRLVNDHDLIVYEDLKITNMTRRPKARPDKQGGYEPNGAKAKTGLNRSIHDAGWGQFTAMTIYKAESAGREVIAVDPRNTSRTCSGCGHASAGNRHGAVFRCLGCGREANADINAAENILRAGRARQLIAA

SEQ ID NO: 2659 - protein, 583 aa, Unknown
  Description of Unknown: uncultivated organism sequence
  Category: MG83 effectors
  Description: MG83-2 effector
MKVVEFKLQLTDDQASKVDTWLNQLRWVWNEALRRVNEERQRYYRKQVNEDGTFGKVEDTGEVWQVWYNKEIKEKAYCCHIADKTRYADYAPCCEIRPYRHQQYANLKELKKWARNAATQKCNPDKPWLKDIPSCFSDFVARDLIKAWEQALSKTNPARYPRFKGNRDTLRSLTDENGHDHLRKDIRGKRNWLVKLNNKLGFMRIIGKHDRFPKDFTVVRICKRASGYYLQVTSKDLEDKTLKRNDRPVGIDVGLKFIVATDQGRVVEPKRYARVAERRLRLLQRKAARRRDAVQKLEGCKGKNLEKVNQQIALLHENIKYRRRQFNHKLSTKLVREYGAIAVEKLQLKNLMRRPEPKLKENGTGYARNNAAAKSGLNKSFADAGLGQLLEMLKTKAEAAGRLFKEVDPSYTSQECSNCHEQVKKSLSTRTHVCPSCGFVEDRDVNAAKNILEKANFSSDYRCWDKREVKPASASSVEGQQESDSGSLDLGKELRAEDALRLTQSQKNNDHLLVEVNSPSKEAVIPTGSGLDEVRLLQQMHVNSETSTPLASEAVIDQVKASTPKPKPRKVKRCLQNQPEAPT

SEQ ID NO: 2660 - protein, 427 aa, Unknown
  Description of Unknown: uncultivated organism sequence
  Category: MG84 effectors
  Description: MG84-1 effector
MNNKVSRYQLLFADEHNELKFKQFNEVMFQLQREMVQIANREVQILWEDMNWSNAVKAKTGVYPTKDEVLERYGSSVRTYIYRTIPQKYNNTSNTSTVLQNVNKRFTQNKKEVMQGKRSIDSYKSTLPIAIHGNSIKIEKIGNKYLVSLSLLSNGYKKQLGIKKGQIIFELMFGRSWSSRQIIDSILSGEFSHTASSITYKNRKWFLNLGYSYPEKEPIKFIDGRTMGIDLGIVKPLVIAFNDNPAHFEVDSDEISEFRKEIHSRRSSLGRQTKHCAESKIGHGVHKRTEGCEKLAQKEANFRDRINHQYSRYVVDLAQKYKCKTIQMEDLTGISKDSTFLKSWPYFDLQTKIEYKAKENGIDVIKINPKFTSQRCSKCGYISEANRPEQAIFQCKKCGFGINADWNAALNISIPGIEKIIKDSEVE

SEQ ID NO: 2661 - protein, 427 aa, Unknown
  Description of Unknown: uncultivated organism sequence
  Category: MG84 effectors
  Description: MG84-2 effector
MNNKVSRYQLLFDDEHNELKFKQFNEVMFQLQREMVQIANREVQILWEDMNWSNAVKAQTGAYPTKDGVLKHYGCPVRTYIYRTIPQEYNNTSNTSTVLQNVNKRFVQNKKEVMQGKRSIDSYKSTFPIAIHGNSIKIEKSGNKYIISLSLLSNGYKKQLGIKKGQITFELMFGRSWSSRQIIDSILSGEFSHTASSVIYKNRKWFLNLGYSFPEKEPIKFIDGRTMGIDLGIVKPLVIAFNDNPAHFEVDSDEISEFRKEIHSRRSSLGRQTKHCAESKIGHGVHKRTESCEKLAQKEANFRDRVNHQYSRYVVNLALKYKCKTIQMEDLTGISKDSTFLKSWPYFDLQTKIEYKAKENGIDVIKINPKFTSQRCSKCGYISEANRPEQAIFQCKKCGFGINADWNAALNISIPGIEKIIKDSEVE

SEQ ID NO: 2662 - protein, 427 aa, Unknown
  Description of Unknown: uncultivated organism sequence
  Category: MG84 effectors
  Description: MG84-3 effector
MNTKVSRYQLLFNDERNELKFKQFNEVMFQLQREMVQVANKATQILWEDMNWSNDVKVQTGSYPTKEEVTGRYGCSVRNFIYRTVPYEYNNTGNIATILQSVNKRFSQNKKEVIQGKRSIDSYKSTLPIAIHGNSIKIEKSGNKYLISLSLLSNGYRKQLGIKKGQIVFELMFGKSWSSKQIIDSIISGEFSHTASSIVYKNRKWFLNLGYSSPDKDSIKFIEGRTMGIDLGIVKPVVMAFNDNPVHFEIDSNEISEFRKQMIARRASIGKQTKYCADSKIGHGVHKRIEGIEKLKQTESNFRDRINHQYSRYIVDIAVKYKCKTIQMEDLSGISKDSTFLKSWPYFDLQTKIEYKAKENGIDVIKINPKFTSQRCSKCGYISEDNRPEQSVFLCKKCGFGLNADWNAALNIATPNIEEIIKNSDTE

SEQ ID NO: 2663 - protein, 431 aa, Unknown
  Description of Unknown: uncultivated organism sequence
  Category: MG84 effectors
  Description: MG84-4 effector
MNTTKVSRYQLLFDDEHNELSFQQANEVLFQLQREMMQIANRTVQLYWEFSGYQSDYKKRFDAYPDKEQLLEDLKYSNLRSYAYAVIAKEFYKNNTGNVATLLQNVDKRYKQNQKDVRLGKHSIDSYKATIPISLHRKSIQISKSKEDYDIRISLLSNVYRKELGVKSGQIYFKLITGKSYSSKQILESILSGKFHYTASSISYRKGKWFLNLGYNFESEELELRPSRVMGIDLGVVKPLVIAYNDTPVHQEIDSNEIQAFRDQMLARRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFRCKNCGFSLNADWNAALNIAQPGIEEIIRETIKQK

SEQ ID NO: 2664 - protein, 431 aa, Unknown
  Description of Unknown: uncultivated organism sequence
  Category: MG84 effectors
  Description: MG84-5 effector
MNTTKVSRYQLLFDDEHNELSFQQANEVLFQLQREMMQIANRTVQLYWEFSGYQSDYKKRFDAYPDKEQLLEDLKYSNLRSYAYAVIAKEFYKNNTGNVATLLQNVDKRYKQNQKDVRLGKHSIDSYKTTIPISLHRKSIQISKSKEDYDIRISLLSNVYRKELGVKSGQIYFKLITGKSYSSKQILESILSGKFHYTASSISYRKGKWFLNLGYNFESEELELRPSRVMGIDLGVVKPLVIAYNDTPVHQEIDSNEIQAFRDQMLARRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFQCKKCGFSLNADWNAARNIAQPGIEEIIRETIKQK

SEQ ID NO: 2665 - protein, 431 aa, Unknown
  Description of Unknown: uncultivated organism sequence
  Category: MG84 effectors
  Description: MG84-6 effector
MNTTKVSRYQLLFDDEHNELSFQQANEVLFQLQREMMQIANRTVQLYWEFSGYQSDYKKRFDAYPDKEQLLEDLKYSNLRSYTYAVIAKEFYKNNTGNVATLLQNVDKRYKQNQKDVRLGKRSIDSYKATIPISLHRKSIQISKSKEDYDIRISLLSNVYRKELGVKSGLIYFKLITGKSYSSKQILESILSGKFHYTASSISYRKGKWFLNLGYNFESEEPELRPSRVMGIDLGVVKPLVIAYNDTPVHQEIDSNEIQAFRDQMLARRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFQCKKCGFSLNADWNAARNIAQPGIEEIIRETIKQK

SEQ ID NO: 2666 - protein, 431 aa, Unknown
  Description of Unknown: uncultivated organism sequence
  Category: MG84 effectors
  Description: MG84-7 effector
MNTTKVSRYQLLFDDEHNELSFQQANEVLFQLQREMMQIANRTVQLYWEFSGYQSDYKKRFDAYPDKEQLLEDLKYSNLRSYTYAVIAKEFYKNNTGNVSLLQQNVDKRYKQNRKDVQMGKRSIDSYKATIPIALQRKSILISKEGANFCVRISLLSNAYRKELGVKNGTLSFKLLFGKSYSAEQILEDIFAGKFKHTSSSISYRKGKWFLNLGYNFESEEPELRPSRVMGIDLGVVKPLVIAYNDTPVHQEIDSNEIQAFRNQMLARRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFRCKKCSFTLNADWNAALNIAQPGIEEIIRETIKQK

SEQ ID NO: 2667 - protein, 431 aa, Unknown
  Description of Unknown: uncultivated organism sequence
  Category: MG84 effectors
  Description: MG84-8 effector
MNTTKVSRYQLLFDDEHNELSFQQANEVLFQLQREMMQIANRTVQLYWEFSGYQSDYKKRFDAYPDKEQLLEDLKYSNLRSYTYAVIAKEFYKNNTGNVSLLQQNVDKRYKQNRKDVQMGKRSIDSYKATIPIALQRKSILISKEGANFCVRISLLSNAYRKELGVKNGTLSFKLLFGKSYSAEQILEDIFAGKFKHTSSSISYRKGKWFLNLGYNFESEEPELRPSRVMGIDLGVVKPLVIAYNDTPVHQEIDSNEIQAFRNQMLARRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFRCKKCSFTLNADWNAARNIAQPGIEEIIRETIKQK

SEQ ID NO: 2668 - protein, 431 aa, Unknown
  Description of Unknown: uncultivated organism sequence
  Category: MG84 effectors
  Description: MG84-9 effector
MNTTKVSRYQLLFDDEHNELSFRQANEVLFQLQREMMQIANRTVQLYWEFSGYQSDYKKRFDVYPDKEQLLEDLKYSNLRSYTYAVIAKEFYKNNTGNVSLLQQNVDKRYKQNRKDVQMGKRSIDSYKATVPIALQRKSILISKEGANFCVRISLLSNAYRKELGVKNGTLSFKLLFGKSYSAEQILEDIFAGKFKHTSSSISYRKGKWFLNLGYNFESEEPELRPSRVMGIDLGVVKPLVIAYNDTPVHQEIDSNEIQAFRNQMLARRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFRCKKCSFTLNADWNAALNIAQPGIEEIIRETIKQK

SEQ ID NO: 2669 - protein, 431 aa, Unknown
  Description of Unknown: uncultivated organism sequence
  Category: MG84 effectors
  Description: MG84-10 effector
MNTTKVSRYQLLFDDEHNELSFRQANEVLFQLQREMMQIANRTVQLYWEFSGYQSDYKKRFDVYPDKEQLLEDLKYSNLRSYTYAVIAKEFYKNNTGNVSLLQQNVDKRYKQNRKDVQMGKRSIDSYKATVPIALQRKSILISKEGANFCVRISLLSNAYRKELGVKNGTLSFKLLFGKSYSAEQILEDIFAGKFKHTSSSISYRKGKWFLNLGYNFESEEPELRPSRVMGIDLGVVKPLVIAYNDTPVHQEIDSNEIQAFRNQMLARRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFRCKKCSFTLNADWNAARNIAQPGIEEIIRETIKQK

SEQ ID NO: 2670 - protein, 438 aa, Unknown
  Description of Unknown: uncultivated organism sequence
  Category: MG84 effectors
  Description: MG84-11 effector
MNTTKVSRYQLLFDDENNELTFKQSNEVLFQLQKEMMQMANRMVQLYWEFSGYQSDYKKQFDAYPDKEKLLEDLKYSNIRSYIYDVLSKEFNKNNTGNVATLQQLVDKRYKQNRKEVQQGKRSIDSYKATIPISLHKGSIRLLKENGDYYAWLSLLSNEYKKELGIKKGRMRFKLLMGKSYSSMQILDSILSGEFHHTSSSLGYRNGKWFLSLGYQFEAKEPKLRESRVMGIDLGVVKPLVIAYNDMPLHHEIDSNEIQVFRDQMHARRRALGRQTKYCAESNIGHGVKTRTKALEKLKQAEANFRDRINHQYSRYVVNLAVKYGCKTIQMEDLTGISKKDTFLKNWPYYDLQTKIEYKARENGIDVVKINPRFTSQRCSKCGFISPENRPDQATFQCKKCGFGINADRNAATNIAQPGIEKIIQETIKQMSAKGKSS

SEQ ID NO: 2671 - protein, 438 aa, Unknown
  Description of Unknown: uncultivated organism sequence
  Category: MG84 effectors
  Description: MG84-12 effector
MNTTKVSRYQLLFDDENNELTFKQSNEVLFQLQKEMMQMANRMVQLYWEFSGYQSDYKKQFDAYPDKEKLLEDLKYSNIRSYIYDVLSKEFNKNNTGNVATLQQLVDKRYKQNRKEVQQGKRSIDSYKATIPISLHKGSIRLLKENGDYYVWLSLLSNEYKKELGIKKGRMRFKLLMGKSYSSMQILDSILSGEFHHTSSSLGYRNGKWFLNLGYQFEAKEPKLRESRVMGIDLGVVKPLVIAYNDMPLHHEIDSNEIQVFRDQMHARRRALGRQTKYCAESNIGHGVKTRTKALEKLKQAEANFRDRINHQYSRYVVNLAVKYGCKTIQMEDLTGISKEDTFLKNWPYYDLQTKIEYKARENGIDVVKINPRFTSQRCSKCGFISPENRPDQETVRCKKCGFGINADWNAATNIAQPGIEKIIQETIKQMSAKGKSS

SEQ ID NO: 2672 - protein, 438 aa, Unknown
  Description of Unknown: uncultivated organism sequence
  Category: MG84 effectors
  Description: MG84-13 effector
MNTTKVSRYQLLFDDENNELTFKQSNEVLFQLQKEMMQMANRMVQLYWEFSGYQSDYKKQFDAYPDKEKLLEDLKYSNIRSYVYDVLSKEFNKNNTANVSALQQLVDKRYKQNRKEVQQGKRSIDSYKATIPISLHKGSIRLLKENGDYYIWLSLLSNEYKKELGIKIGRMRFKLLMGESYSSMQILDSILSGEFHHTSSSLGYRDGKWSLNLGYQFEAKEPKLRESRVMGIDLGVVKPLVIAYNDMPPHHEIDSNEIQAFRDQMHARRRALGRQTKYCAESNIGHGVKTRTKALEKLKQAEANFRDRINHQYSRYVVNLAVKYGCKTIQMEDLTGISKKDTFLKNWPYYDLQTKIEYKARENGIDVVKINPRFTSQRCSKCGFISPENRPDQATFQCKKCGFGINADRNAATNIAQPGIEKIIQETIKQMSAKGKSS

SEQ ID NO: 2673 - protein, 438 aa, Unknown
  Description of Unknown: uncultivated organism sequence
  Category: MG84 effectors
  Description: MG84-14 effector
MNTTKVSRYQLLFDDENNELTFKQSNEVLFQLQKEMMQMANRMVQLYWEFSGYQSDYKKQFDAYPDKEKLLEDLKYSNIRSYVYDVLSKEFNKNNTGNVSALQQLVDKRYKQNWKEVQQGKRSLDSYKATIPISLHRKNIQLLKENGDYYVWLSLLSNEYKKELGIKKGRMRFKLLMGESYSSMQILDSILSGEFHHTSSSLGYRNGKWFLNLGYQFEAKEPKLRESRVMGIDLGVVKPLVIAYNDMPLHHEIDSNEIQVFRDQMHARRRALGRQTKYCAESNIGHGVKTRTKALEKLKQAEANFRDRINHQYSRYVVNLAVKYGCKTIQMEDLTGISKEDTFLKNWPYYDLQTKIEYKARENGIDVVKINPRFTSQRCSKCGFISPENRPDQETFQCKKCGFGINADWNAATNIAQPGIEKIIQETIKQMSAKGKSS

SEQ ID NO: 2674 - protein, 437 aa, Unknown
  Description of Unknown: uncultivated organism sequence
  Category: MG84 effectors
  Description: MG84-15 effector
MSNILSMPVKVMRYQIVKPVDADWELLGKVLRDLQDDTRKVLNKVIQLCWEWQGFSAEYKQQYGIYPKTSDFSHYKNIDGYCYKKISDFFTRLHTGNLSMTIKRGVQRWKTDLAEVIKGSKSIASFRSNCPIDIHNKSINIFNVEKEYYAKLSLLSKTYKKELSRDLGQITVLINPGDKSGKDILDRCISGEYKISSSQILQKKDTNTSKNNKWLLNLSYSFKSQKKIVDSNKVLGIDMGIIFPVYMAIHGTLIRDKIDGGEIEHFRKEVENRKIKLQRQGKYCGQGRIGHGTKTRVRPIEFAKEKIANFRNTVNHKYSRYIVDFALRNRCGIIQMEKLEGINKDKTFLKSWPYYDLQQKIIYKANEAGITGKFIDPRYTSQRCSKCGYIDEENRPEQKTFICKSCGFETNADYNAALNIANPDIENLIKKELSREA

SEQ ID NO: 2675 - protein, 437 aa, Unknown
  Description of Unknown: uncultivated organism sequence
  Category: MG84 effectors
  Description: MG84-16 effector
MSNILSMPVKVMRYQIVKPVDADWELLGKVLRDLQDDTRKVLNKVIQLCWEWQGFSAEYKQQYGIYPKTSDFSHYKNIDGYCYKKISDFFTRLHTGNLSMTIKRGVQRWKTDLAEVIKGSKSIASFRSNCPIDIHNKSINIFNVEKEYYAKLSLLSKTYKKELSRDLGQITVLINPGDKSGKDILDRCISGEYKISSSQILQKKDTNTSKNNKWLLNLSYSFKSQKKIVDSNKVLGIDMGIIFPVYMAIHGTLIRDKIDGGEIEHFRKEVENRKIKLQRQGKYCGQGRIGHGTKTRVRPIEFAKEKIANFRNTVNHKYSRYIVDFALRNRCGIIQMEKLEGINKDKTFLKSWPYYDLQQKIIYKANEAGITVKFIDPRYTSQRCSKCGYIDEENRPEQKTFICKSCGFETNADYNAALNIADPDIENLIKKELSREA

SEQ ID NO: 2676 - protein, 377 aa, Unknown
  Description of Unknown: uncultivated organism sequence
  Category: MG84 effectors
  Description: MG84-17 effector
NWSNAVRAKTGVYPTKDEVLERYGSSVRTYIYRTIPQEYNNTSNTSTVLQNVNKHFTQNKKEVMQGKRSVDSYKSTLPIALHGNSIKIEKSGNKYLISLSLLSNGYKKQLGVKRGQITFELMFGRSWSSRQIVDSILSGEFSHTASSIIYKNRKWFLNLGYSYPEKEPIKFIDGRTMGIDLGIVKPLVIAFNDNPAHFEVDSDEISEFRKEIHSRRSSLGRQTKHCAESKIGHGVHKRIEGCEKLAQKEANFRDRVNYQYSRYVVDLALKYKCKTIQMEDLTGISKDSTFLKSWPYFDLQTKIEYKAKENGIDVIKINPKFTSQRCSKCGYISEANRPEQAIFQCKKCGFGINADWNAALNISIPGIEKIIKDSKVE

SEQ ID NO: 2677 - protein, 398 aa, Unknown
  Description of Unknown: uncultivated organism sequence
  Category: MG84 effectors
  Description: MG84-18 effector
REMMQIANRTVQLYWEFSGYQSDYKKRFDAYPDKEQLLEDLKYSNLRSYTYAVIAKEFYKNNTGNVATLLQNVDKRYKQNQKDVRLGKRSIDSYKATIPISLHRKSIQISKSKEDYDIRISLLSNVYRKELGVKSGLIYFKLITGKSYSSKQILESILSGEFHYTASSISYRKGKWFLNLGYNFESEEPELRPSRVMGIDLGVVKPLVIAYNDTPVHQEIDSNEIQAFRNQMLDRRRALGRQTKHCAESNIGHGVKTRTKALEKLKQTEANFRDRINHQYSRYVVDLAVKYKCKTIQMEDLSGISKDDIFLKNWPYYDLQTKIEYKAKEKGIDVVKINPKFTSQRCSKCGYISPENRPDQATFQCKKCGFSLNADWNAALNIAQPGIEEIIRETIKQK

SEQ ID NO: 2678 - protein, 640 aa, Unknown
  Description of Unknown: uncultivated organism sequence
  Category: MG85 effectors
  Description: MG85-1 effector
MCTIKCMSQITIQCRFISSESTRHRIWELMAEKNTPLINELLEQVGQHPEFETWRQKGKLPSGIVSKLCQPLKKEERFIGQPSRLYISAIHVVDYIYKSWLALQLRLQRKLEGQTRWLEMLKSDSELIEVTGCSLDAIRTRAAEILAQSASQSDPVTRQQTQDKKKKKFKAKNSNTSLSNTLFEIYRNTEDILTRSYISYLLKNGCKVSDKEEDAEKFAKRRRKVEIRVERLQEQLKSRMPKGRDLTSDHWLETLVIATHNVPKNEDEAKSWQASLLRKSSSVPFPLVYETNTDLTWFKNQKGRICVNFSGLSEHTFEIYCDSRQLHWFKRFLEDQQIKHDSKNQHSSSLFTLRSARLNWQEGEGKGEPWNVHRLTFYCTVDTRLWTNEGTEQVREEKAFEIARTLTRMKEKGDINKNQQAFVKRKHSTLARINNPYPRPSQPLYKGQSHILVGVSLGLDKPATVAVVDATTGEVFTYQSIRQLLGDNYKLLNRERKQQQSKSHQRHKAQKSAAPNSFGESELGQYVDRLLAKAIVAIAQTYQASSIVLPKIGDMREIVQSEIQARAEAKCSVIEGQKKYAKQYRCSVHKWSYGRLIESIQSQAAKTGIAIEEGQQPIRGSPQEQARELAIIAYKSRKLL

SEQ ID NO: 2679 - protein, 467 aa, Unknown
  Description of Unknown: uncultivated organism sequence
  Category: MG85 effectors
  Description: MG85-2 effector
MFPSFCSPPFLSYFSTPLNGYNRCAISYLLKNGCKINDKEENPEKFAQRRRKLEIQIQRLTEKLAARIPKGRDLTDTQWLEALFTATQTVPENETEAKFWQNSLLKKSSSVPFPVAYETNEDLVWVKNQFGRICIKFSGLSEHTFQIYCDSRQLHWFQRLLEDQKIKKNSKNQHSSALFTLRSGRISWQEGEDKGDPWNVHHLTLYCSVDTRLWTEEGTNLVKEEKAEEIAKTITQTQAKGDLNDNQQAHIKRKNSSLARINNPFPRPSQPLYQGQSHILVGVSLGLENPATIAIVDGTTSKVLTYRNIKQILGDNYKLLNKQRQQKHLLSHQRHIAQRMAASNEFGDSELGEYIDRLLAKEIIAIAQTYKAGSIVLPKLGDMREQVQSEIKAKAEQKSDLVEVQQKYAKQYRVSVHQWSYGRLIANIQCQANKAGIVIEEAKQPIRGSPQEKAKELAINAYQSRKA

SEQ ID NO: 2680 - protein, 641 aa, Unknown
  Description of Unknown: uncultivated organism sequence
  Category: MG85 effectors
  Description: MG85-3 effector
MSVITIQCRLVAKEFSLRYLWELMAQKNTPLVNELLQAIVQHSDFESWLQKGSIPQATIKALCDSLKNDPRFSGQPGCFYTSATSLVSYNYKSWFALQKRRQQKIEGKERWLNLLKSERELEEECDRTLEEIRAKATQILTQFQPQAENAETPPGEATQKKKGKKSKSTPSKGKAASLFNTLFNAYAQTKDPLERCALAYLLKNNGEVSLVEEDLEAYQQRRRKKEIEIERLKEQLKSRHPKGRDLTAEKWLETLEAARTQQPESEAEAATWQANLLRNSSPVPFPVNYETNEDLTWFKNEAGRICVFFSGLREHHFEVWCDNRQLHWFERFFQDQQIKRQSKNQHSSSLFTLRSGRIGWQECTGEGEAWNIHHLKLYCTLDTRLWTAEGTEQVAQEKAAEISNILTKTKQKDDLNEKQLAFIKRGETMLARINTPFPRPSKPLYQGQSEIVVGVSLGLEKPATVAVIDVPGDRVLAYRNVKQLLGDHYPLLNRRRQQQRSLSQKRQKAQKQGAANEFGESELGQYIDRLLAKEIVAIARSYQAGSIALPKLTDIREILHSEMQTRVEKKIPGYKEAQDKYAKQYRVNVHRWSYGRLMDAIASQAAKVGIVIEVGKHPSEGSFQDKAREVAISAYCDRSVN

SEQ ID NO: 2681 - protein, 669 aa, Unknown
  Description of Unknown: uncultivated organism sequence
  Category: MG90 effectors
  Description: MG90-1 effector
MLVAKFGVRKFLTGESLALAEMRAAAQYYQSLVTIERWRRSQFAAIRSETVPGLGEIDEAYQQLDEWIGEHAGKGGKRGGIREKRRKATAATGRPVKPVKKAVDVSDEVDLITELKAWRKAAAELAKPMRGQFAAVVEPAQQEFTARSARLRSAWGSNDGDRHAKRRSDIQARDEMLAEAQWPEAWRRLAQLETQADALRGWIKEARLLSVGTYHSIQRVDLPAACKRPKPRPDGEPRRPKRRPTYSRRRLRRIGWEINDATWGDLLAGKNNELRITDVRNQGGANGGRVKQRATVHMRVRAETREALAAAPDYYRPKYDGPAGNWWVTMDVVLHRPIPPDTKVRWAYLVPSEESPGRWEYSLQFTLDPTEPLIQRAPGTGTVNVRLCWTQDNENKTLIVAHVNGEPLRLPGGAHERGRRAGVVESLRFAERLRSVADTLFDSARAEVAKRIASQPTRVFEAAHGLSQWRAHWKLKRVSAVMLEVLDKREEEYAMWKRWRDLRRAAHEDLFEPDIGKYAAILGLTTPDTIFTFWLAMWRRKDEHLEAMAAGARNHAMGRRRDFYRVTAAKLCTQFEICEVSGAVDLDQIALRDKAEDKPNELHQAARHNRQLACVHELKAALKAAFGPDRYKERDQSGAAKKAAAARDAANDVETNANTDEGPTVSAAE

SEQ ID NO: 2682 - protein, 716 aa, Unknown
  Description of Unknown: uncultivated organism sequence
  Category: MG90 effectors
  Description: MG90-2 effector
MSVDDPPLRSRARVLVYSYFCKPATEADEHALCEQLRLAALYRRELVQIENLARALQRAWSATYAESALEEERRRFRRMPPAEPDPVDPDAGSRWAEISAAARAWSDGATAREAGVRSLVALGVSEGLAQATVDQAKIASERSRAFNSVRRHFSQDLGLTWGTYQHAAEAFESQHRSVSMFDDVRVPPRAAVGCFAVHLQPARALRGSDDAWIRFGSIARLGSDRARGAEIDRSGRPRPARHHQVMLRIGTQADRRPRWVTVLALLDRPVPPTAIVSWAKVCRRRVGPTHRWELQITTQVDEACLVLDPSLAERAVRLWAAGVGKRGIARTLTMRIQDARRCALAALRAGISQGAGALDGQVQEATAALAHPPVPEPARSRGETVGVDIGWRRMGDAMRIARWWGTDGRSGELTIRRQVLDADVKADDLRGIRDQHKNEILAQLLDYTVSLRERSPRIPDADWIVAELPSMRQWRRAARLVGLVGRWRDHRIPGDDSIFEAVLGWLKQDRHLWAWEANQRQKRQRRVDEQIRLFVVWLCRQYGRIGVEAPMVAGLVRKVPRCVACASSPTRCTACSDRERLRRLTSTRVTHAAPARTRQLLETIAPTHGSVVIRLDPAYTTLDCALQDEAGLVCGHRRVEVVDWSPLEIACARCSGTEDQDLTAAKNLARRASGVALDEDGRPLATDSAGRSKASKRKLRPRRNRSGRRVDRSHPT

SEQ ID NO: 2683 - protein, 605 aa, Unknown
  Description of Unknown: uncultivated organism sequence
  Category: MG90 effectors
  Description: MG90-3 effector
MYAQKYGAKKPLEWTERHEQSFLDRRALWNDLVEVYRQARVRERELYSAADPEIESGYAEVDALDLALDAQPRQTDEERAAWRDILAQLKSTRAALWTKIRELKLGAEIKAQIRTIWQETQRATYTLACGKARKYPALHWADCNDLHDSLWKSIRAKKHPRPRTFTSRESLYRQLQSQTVGGVRVEVPDRKRRKIEGGTLTGATWDALTSERGYGGVKIQPYTLRRATRRWALLEFSIDSGATLRIPIRVHREPPKEALIKGVRVVRERIPGRRFPYEWSVVLSVAAEPLRSVIRCPSERTLYAGLGWRHTPEGLRVLAGIDDLGREWHVTLPEEYVLQWRYSRSLEAHLRLLRNAEAARLGVDPRSTRELFEHPDSRRWAYGEHLGEQTHAALLARNCEAAAAAEIFGERAGRARFSGLRSTLLRRRKDLYIRVARQIVGSSTRLVLGALDGADIQERTKDLPLPARHLRTIAAPTRLRDEIEWQARKAGVEVVTLDATNASRYCAVHPDVDLYAGRDESRLWLACEGCGVPLDRDANYARNLFRRDAPERFERCDWQALTRERSRLEIPNITHEVQRHWSTPQPRESRVQYTARLALANRDNC

SEQ ID NO: 2684 - protein, 445 aa, Unknown
  Description of Unknown: uncultivated organism sequence
  Category: MG90 effectors
  Description: MG90-5 effector
MTDAPATVTRTISLEVAKPLNCSWDELRVLLRTQRCIIPQLLRSGMDALIACGVVETKAVHGHVCPDARGTSPATVVYQSMKAELDRIQHGKWRDAARPALNLPAGMLSALARRVTQTYKLRPSFKGHQPIPVRRAELHVEADGDAVVVRVLLMGGGTGPRGGHRLLVRASEGFHWSIARRLAKGELAYGAGSLVFSERKDKWFVRIAYEAPVRVVQGADPSVALVVRRGVHTALMLMGTDGSYRRVPGEKVNAQLHALEARMRAARQIGADELGRGARGHGKRRRYAHYDALHGKRRRVVRTWCQQMGAAVVRQATRIGAGKVVIENFGGFAPDKSVAFIGSRFPFYQLKQSILEACEKRAIAVDEVAADYVSTTCPSCSVADARSHNRRTGTFHCLACGLSRPADFVAALNMLRRADVDSSTWDERMDQYKRLVESLKEQAAE

SEQ ID NO: 2685 - protein, 516 aa, Unknown
  Description of Unknown: uncultivated organism sequence
  Category: MG90 effectors
  Description: MG90-6 effector
METATEENHVDRVYQFGCRPPPGAEHEIALQLLGQAYLYRDDLRRAYNTQKRHVRMLLESKDAASHAIQFEHEMLKERIRSARASRGHLLDAGTYWLIEKAMLAASKANKLDPIRAQEWDGTGRIGAAIQSSAQFPAAAWNHSRVKLSKEDAQQFNTRKGPGSRSHDEDAVLTIFVGEAKAERALHWPVKLHRDFPSGAIVKQVAVQRTRSGHRFRWKVLITISHERSNERDPEAKGVVGLDVGWRTEGDLGMRVATHDASDDADALRIHTPEALFYADAVDSTRDMLFNEAKEYAFSSGLPGTEHARLWRDKERMRRLARSTQDLGAVWWHERDRHLRDISCAVRLRSIRRRLDAFRSYADSLAKRYRMIALEDMPMIDWVGKGKTAALERLRSIASLSLLQNIIAERFGAERVDWVPAAHTSMVCSSCKVQRELTVGPGPHWVCAACGHEHHQDYNAATNLRLLSEQWIADGKSLRARKRKSKKGNEKKHVNAIATGDALGMTVTARKSIATAA

SEQ ID NO: 2686 - protein, 645 aa, Unknown
  Description of Unknown: uncultivated organism sequence
  Category: MG90 effectors
  Description: MG90-7 effector
MYAQRYGAKAPLEWTEAHARVLLLADQLWDDLRAIWIQCLHEQEMAEDATGDAELLSARGAVSRTEAQVDAAFQARRDWRQRHRSKQAPEEIEASIKAAISAAREARRELWPVLKRVRKEIREELLDLWNARDQQMRVLAQGRTRKYTDLHDGVYNDIFKRFRVAAKEGAKQGIVPRPSHEHLSQSIYRQIQPHNFGGKLVSDPKKPGKRRKRIGGSQKGAEWSTLCTTGCGKVRVLPYSPGPRVTQRWGLLVMPVDANGLEIKIPIRVDDREPPQGAQIKGVRVVRRDRKWHTVFSVDAPPPSIERGAGTLYAGLNWRLMADGSLRVLDGIDETGKRYQVCLPRWQLAAVEYAEALQAATDRRAVQAALQLEADHPKRAKEIAEAVRRRNWAALYPLDTAWADGTHGKQGRRQHTALLRARKIAGGDLAKLTELVAEILGDRAGRRRIAGQKSKNTRRRESFYRECAQAIATRFGRLVVAKSDGRKLAKRVDEETGEESNLPAPARRNRQIAAPYSLMQYLRWAFVRAGSPVVDLEAKHKSHTCPICGQEMQGEASRGELYLSCSEHGMWDRDHALAAALWRDDAAGDHERWSLALSRRERPRAKIVRIDEEIGGSFTEHYHRLQYVSGGALEDKGKSRGATRR

SEQ ID NO: 2687 - protein, 482 aa, Unknown
  Description of Unknown: uncultivated organism sequence
  Category: MG90 effectors
  Description: MG90-9 effector
MKRDSNSPAERSRKAKAAKLARWKAAHPSVSRGLLYRMDPTVELGAGMGRMTDLDRALWNMTHQWWLMSSRPLRRVKKSDLDAVVAQARTDIPWLAELPAQACKAVAKRYWQTWERCWSGVGGAPNFHSRLKDRPSFDIPQARDLNITRVSKKFATVQVPKVGKVTIRYHRPIPVGARVTGARVTNDHGRWTLALRVELPKPELRSPVESRPVVGFDRGVVIPLAGSDGTEFNHPDWLTPGEKRHLRYLERQSARERHARWDRSDGRGKGRIGANERKTYDAIASVQAKAARRRKDWHHQTSRKIADGYSVAVFEALRIKNMTKSAAGSVKAPGTNVAAKSGLNRVILNEGWGTLLDLTRYKMADNGGAVVTVPAPFTSLTCHTCGSTTPGQRKNQALLVCGDTDCGWTGNADFNAACNILMRAVSGGLVPTLSAGIVDDARSRYELEERTDAMPPVGTEAPLKLDGPGKRENRLGQRTVAA

SEQ ID NO: 2688 - protein, 394 aa, Unknown
  Description of Unknown: uncultivated organism sequence
  Category: MG90 effectors
  Description: MG90-10 effector
MEEGSADKGHVTIVYPAYPNVDQERELLRTLGVVRGLYNHFLAESIADIMEGDRFPTPREMNKAITVMRGRDIGLVSVAVFTLRDAPLRVHAAMTSFARLSARSGELRLPRFKSESRYRSLAFDPKGVKFDGRRIVFGKWMKLRCGNLDRNRKLHRPEGGRIVTARIVRKGSGRWYVHITFEVDRRYRSEIDLSDPAEPEAYDLGLCDIITDSKGERIGAPDLYARHENEIARLQRQIASMEDGPKRRKKQRRLSVLHERIRRRRDGYLDEVADRMVSGHSAVILEDLRLRRMIERDNSPAPRRKLFTEAALGTLVRKVEAKAERACIPLVKVDPAYTTRRCSCCGHVGEKMPLSLRVFSCPRCGLEMDRDHNAALNILGSGMGTLRGSAEPSG

SEQ ID NO: 2689 - protein, 391 aa, Unknown
  Description of Unknown: uncultivated organism sequence
  Category: MG90 effectors
  Description: MG90-11 effector
MRRGGGSEDKWFVTRVYPAYPNRTQERELLRQLDVARGVYNHFAEACIHCLIDGTHVPDPMEMNREFTLMRADDCLLRSVNSYTLRETINRVWQAVEKCERRSLADGELHVPRIKTPPRFRSICFDPKSSKIENSRIRLNRELSVRCRNLARPRNGRAVAVRAVRRGTGRWYICITYETDRVVRGEMDVGEPDRAEGYDLGLVDLITDSRGNRVRAPDFFREGEAELAHLRRQLSRLEEGTAKWLKKRRRIARIEERIRRRRDGCLDRIADWMVSGKSVVVVEDIDVRRLASREDGTLVRRKRFTEAAWATLVGKAERKARKTDVRLIRVNPAYTTRTCSRCGHVGDGIPLSERMFRCPVCGLEMDRDRNAARNILGSGMGTQRCTAEPSG

SEQ ID NO: 2690 - protein, 430 aa, Unknown
  Description of Unknown: uncultivated organism sequence
  Category: MG90 effectors
  Description: MG90-12 effector
MSTITFEPPTCAFCGKKAEPNETFCHGNGNIYICTECVDEFHESINAANTFIENARKIQETDNMQKSRLPTPSQLKAHLDEYIIGQDYAKRVISVAVYNHYKMLKIKGQEKAGKTEKTVDLEKSNVLLLGPSGSGKTAIVRAIAKKLKVPFTMTDATLYSAAGYVGMDVECMVRQLVEAANGNIEAAERGIIFIDEIDKTSRKGENLSTTADPGHEGVQQSLLKLLEGNVVNVPEKGRRAHPEADTITVNTENILFIVGGAFEGIEKITAKRLRSENQAGTMGFGSQLVDKKNQQYNEYIEKVSTDDLKKFGMLPELLGRVPVIAPMKELTEDQLVEILHKPKNALTKQYQRLMAQDGVDLQFTDAALRVIARRAVEKKTGARGLRGIMEDILNPVMFETPDRNEDTIIIDANDDDVSITYQTKRRKEAV

SEQ ID NO: 2691 - protein, 402 aa, Unknown
  Description of Unknown: uncultivated organism sequence
  Category: MG90 effectors
  Description: MG90-14 effector
MQTVRYNYRLYPTKTQETVLNRLFGCCRVVYNDTIDFFNNNFNPNNQSKLPTAANASKQILTSAKKTVKRAFLKEVSSVALQQEFRNAWLACLHGVSHTSNQKPAKRKTKKHNPVNSANFTSNGFSINQHGVYISKIGVIKTKWSRPMPSEPTSCTISHARNGRWYASFVVKRPKTPFAQCDNNAGIDMGLTDMATIVNTKGDRWKIANPRNYAKIQDKIGRLQRHLSKQTKGSKRYERTRHQIALLYSKAHDALADYQWKNVLNIIRETQAIGVETLDIKSMTAKHGKSVRDASMRSFLNKLGSKADEHCRVIIRLNQWLVTTKVCALCKHKLKVGLPEYARHWVCPKCGAHLDRDYNAALNILDAAGLAGSLNARGGSVISFLASAENGCSRRTAYHPNF

SEQ ID NO: 2692 - protein, 533 aa, Unknown
  Description of Unknown: uncultivated organism sequence
  Category: MG90 effectors
  Description: MG90-15 effector
MANVLNYKYGIFPTAPQRKHLTRRMRECRLQYNRAVSTRKRLKGSLMCYKTLPVLHEVMGLEKDNTNPNRRTAIEKVGAAYPNIPKDKWSRIYDLKTIFGKTFDIKKRHCDLKVLAAECDALLRAELTEFRAHFRQPESTRPARPPKRPVYFKLLQAASRHAGYEAKIHMDRAFGSRLGISRIRFSVSGCSGGTVANFERACDPSPDQRRIGASGEPNYKRRVDAYGYQVFRNEDILTGNKIKIRGLPTGMDEVEINLHRPLPDGHKLKRVAVMERGGQWQVVMTLEVTDETYQLVPSCPRKAIGLDPGTATALTSAVLDRDTGSIEYGAWDWSPLDAAEDKMEAISQKLSGMQGPDRRTGQRASNRWKKLNARRRRLHATIARRRLDMHHKISRELVNHGLVAIGNWEPPKVVKGRKEFRKGKTKAVEAGPKGIKAKRRGGRDRGIATLRSLAAQKGVRAGVEVIASADERYTTQQCSKCKELTGPKQDLSTRKWTCSKCGSEHDRDQNAALNILNLALEASAKMGTQSLEK

SEQ ID NO: 2693 - protein, 533 aa, Unknown
  Description of Unknown: uncultivated organism sequence
  Category: MG90 effectors
  Description: MG90-16 effector
MANVLNYKYGIFPTAPQRKHLTRRMRECRLQYNRAVSTRKRLKGSLMCYKTLPVLHEVMGLEKDNTNPNRRTAIEKVGAAYPNIPKDKWSRIYDLKTIFGKTFDIKKRHCDLKVLAAECDALLRAELTEFRAHFRQPESTRPARPPKRPVYFKLLQAASRHAGYEAKIHMDRAFGSRLGISRIRFSVSGCSGGTVANFERACDPSPDQRRIGASGEPNYKRRVDAYGYQVFRNEDILTGNKIKIRGLPTGMDEVEINLHRPLPDGHKLKRVAVMERGGQWQVVMTLEVTDETYQLVPSCPRKAIGLDPGTATALTSAVLDRDTGSIEYGAWDWSPLDAAEDKMEAISQKLSGMQGPDRRTGQRASNRWKKLNARRRRLHATIARRRLDMHHKISRELVNHGLVAIGNWEPPKVVKGRKEFRKGKTKAVEAGPKGIKAKRRGGRDRGIATLRSLAAQKGVRAGVEVIASADERYTTQQCSKCKELTGPKQDLSTRKWTCSKCGSEHDRDQNAARNILDLALEASAKMGTQSLEK

SEQ ID NO: 2694 - protein, 394 aa, Unknown
  Description of Unknown: uncultivated organism sequence
  Category: MG90 effectors
  Description: MG90-17 effector
MEEGSADKGHVTIVYPAYPNVGQERELLRTLGVVRGLYNHFLAESIADVIEGDRFPTPREMNKAITVMRGRDIGLGSVAVFTLRDAPLRVHAAMTSFAKLSARSGELRLPRFKSESRYRSLAFDPKGVKFDGRRIVFGKWMKLRCGNLDRNRKLHRPEGGRIVTARIVRKGSGRWYVHITFEVDRRYRSEIDLSDPAEPEAYDLGLCDIITDSKGERIGAPDLYARHENEIARLQRQIASMEDGPNRRKKQRRLSVLHERIRRRRDGYLDEVADRMVSGHSAVILEDLRLRRMIERDDSPAPRRKLFTEAALGTLVRKVEAKAERACIPLVKVDPAYTTRRCSCCGHVGEKMPLSLRVFSCPRCGLEMDRDHNAALNILGSGMGTLQGSAEPSG

SEQ ID NO: 2695 - protein, 394 aa, Unknown
  Description of Unknown: uncultivated organism sequence
  Category: MG90 effectors
  Description: MG90-18 effector
MEEGTADKGHVTIVYPAYPNSSQERELLRTLGVVRGLYNHFLAESIADVMEGDRFPTPREMNKAITVMSGQDAVLRSVSVFTLRDAPLRVHAAMTRFARLSARSGELRLPRFKSESRYRSLAFDPRSVRFDGRRIVFGKWIKLRCGNLDRGRSLHIPEGGRIVAARIVRKGSGRWYVHITFEVDRRYRSEIDLSDPAEPEAYDLGLCDIITDSKGEKIEAPDLYARHENEIARLQRQIASMEDEPGRREKQRRLSVLHERIRRRRDGYLDQVANHMVSGHSAVILEDLRLRRMIERDDSPAPRRKLFTEAALGTLVRKVEAKAERACIPLVKVDPAYTTRRCSCCGHVGDKMPLSLRVFSCPRCGLEMDRDHNAALNILGSGMGTLRESAEPSG

SEQ ID NO: 2696 - protein, 427 aa, Unknown
  Description of Unknown: uncultivated organism sequence
  Category: MG90 effectors
  Description: MG90-19 effector
MEQKKNICSVCGKPYDSHLFFFTHDKEDMCICFDCVEKIYGRIQQDKERYPATENIDETRPPAKKNGRIKPSDIKAYLDQYIIGQDKAKQVLAVAICNHYKMYRLKKNGAVDSIHKEMEKSNVLIVGPSGCGKTAVVKRLGKFLQVPVITVDITAYSAAGYVGKDVETILRDLWIAAEGDISLAEKGIVYIDEVDKISRKGENLSTTTDPGHEEVQQGLLKMLEGNTIDVPKRGNREHPQAETIKINTENILFILGGAFEGIEKIIAQRHKRKSGGSIGIGAVIEDMDDEQTFNKNILDIRTEDLKKFGMLPEFLGRIPVICPMQELTEEALVNILTKPKNAIVKQFQALLADDDIELEFTDKALNKIAQQAIERKTGARSLRGVMEDIMNPVMFRIPDEEGLNKVVVDVDKDDNFDIKEIKEENAA

SEQ ID NO: 2697 - protein, 370 aa, Unknown
  Description of Unknown: uncultivated organism sequence
  Category: MG90 effectors
  Description: MG90-20 effector
MQAVDGLDINILTPAEIKNGLDQYVIGQDEAKRVLAVSVYNHYKRILSGKGADVELQKSNVLLLGPSGVGKTLLAQTLAKMLGVPFAIADATTLTEAGYVGEDVENILLKLLQAADFDVQKAQVGIIYIDEIDKITRKSENPSITRDVGGEGVQQALLKILEGTVSNVPPNGGRKHPQQEFIQIDTTNILFICGGAFDGLDKYILRRTDRSALGFGSSLKDNSEDAQRALLRKVEPHDLVKFGLIPELIGRLPVITVLDDLDEDALVRVLKEPRNSLVKQYKELLSMDSVELEFTDEALHAIARKTIERKTGARGLRSVMEGILLPVMYDVPNDPTIIRVTIDKDTVEGGEAHLEYGAVRKRYKNQTALS

SEQ ID NO: 2698 - protein, 408 aa, Unknown
  Description of Unknown: uncultivated organism sequence
  Category: MG90 effectors
  Description: MG90-21 effector
MVNKNNEFCCMCGSKEDEVDKLIRGKYGYICDNCISIASDLLNDDEEEKNITNNMQLATPSQIKAHLDQYVIGQDEAKRTLAVAVYNHYKRLKQNKKSDVEIQKSNILMIGSTGSGKTYLAQSLAKFLGVPFAIADATTLTEAGYVGDDVETMLRTLLQNANYNIESAQRGIIYIDEIDKISRKGENMSITRDVSGEGVQQALLKIIEGTISEVPVTGGRKHPQGETVKINTSNILFICGGAFDGIEKIIGKEEIHNSIGFGANITDKKESVADLSKVEQHDLVKYGLMPELIGRLPIITTLNPLSEDDLVHILTEPKNAITKQYQELLAMDGVKLEFEDEALRKIAELAIQKKSGARGLRSIIESAMQKVMFDVPDMSSAKKVVITAECVEGKADALVYGARNKKIA

SEQ ID NO: 2699 - protein, 366 aa, Unknown
  Description of Unknown: uncultivated organism sequence
  Category: MG90 effectors
  Description: MG90-22 effector
MRNRGGPWNICGKFPPEIKKFLDEYVIGQEYAKKVISVAVYNHYQRITAPRTAPQLDKSNILLIGPTGVGKTLIAETLARFLKVPFAIADATPLTEAGYVGEDVENILLRLLQAADGNIQLAEIGIVYIDEIDKIGRKSESPSITRDVSGEGVQQALLKILEGTVANVPPQGGRKHPGQQFLQVNTRNILFICGGTFEGLDKIIERRICSGTIGFAANITRTHPENEDELLRCVQPDDLIKYGMIPEFVGRLPVIAPLHSLSQSALIDILTQPKNALLKQYAYYFEREGVKLTFTPEALAAVAERALQLRTGARGLRAVLEETMLEIMFELPTRHNIIECIITPEVIRKEKPPVYIHGRRTVRRTH

SEQ ID NO: 2700 - protein, 412 aa, Unknown
  Description of Unknown: uncultivated organism sequence
  Category: MG90 effectors
  Description: MG90-23 effector
MFETKIPIRRCSFCGKGQNEVEALITGPNGVAICNVCVDECYEMIHQKEGEKGKSPVEIGKLPTPKEIKEFLDQYVIGQEEAKKVLSVAVYNHYKRIISREKGEDEVELEKSNILLIGPTGSGKTLLARSLAKLLDVPFAIADATTLTEAGYVGEDVENILLRLIQAADYDIEKAERGIIYIDEIDKISRKSENPSITRDVSGEGVQQALLKILEGTIANVPPQGGRKHPHQQYIQIDTSNILFICGGAFVGLEEIIARRIGKGTMGFTADVDKIKMDRDQLLKYVEPDDLVKFGLIPELIGRLPVVATLSELKEEDLVRILKEPKNALVKQYQKLLELEGVELVFTDDALREIAREAIRRKTGARGLRAIMEKIMMDVMFEVPHRKEIKKVIIDKKAVKTGKPKYEVAKAS

SEQ ID NO: 2701 - protein, 427 aa, Unknown
  Description of Unknown: uncultivated organism sequence
  Category: MG90 effectors
  Description: MG90-24 effector
MAKNDEKLIRCSFCGKREDEVDRIVRGLDAFICNECVKLCGEIMGFDYEEPEYTVEQYEGDLPFQEIPKPREIKEYLDEYIIGQDEAKKAISVAVYNHYKRILAEDQGDTELQKSNVLLIGPTGSGKTLFAQTLAKLLKVPFAIADATTLTEAGYVGDDVENILLRLLQAADFNVPLAEHGIIYIDELDKIARKSENTSITRDVSGEGVQQALLKILEGTVAGVPPLGGRKHPQQEFIQVNTKNILFICGGAFDGIEKIIEQRLDKKSMGFGADIKSKRERAAGEIMLSVRSHDLQKFGIIPELIGRMPVIVPMKQLTRDDLVRILKEPKNAITKQYKALMKYDGVTLEFEEGALEAIADRAIELDIGARGLRSVVESIMTDVMYDVPSQDRIEKVIITEASVREGTGPKLVRRPKPRIDPDLALNL

SEQ ID NO: 2702 - protein, 442 aa, Unknown
  Description of Unknown: uncultivated organism sequence
  Category: MG90 effectors
  Description: MG90-25 effector
MARNDQMRLRCSFCGKTQDQVDKLISGMNDTFICDECVELCAELVNDDLELRAAQKRQRAQKNAKPLPKPQEIKATLDEYVIGQDRAKITLSVAVYNHYKRIFCGDQTDVELQKSNVLLLGPTGVGKTMLAQTLARTLDVPFAVADATTLTEAGYVGEDVENILLRLIQAAEFDVERAETGIIYIDEIDKIARKSENPSITRDVSGEGVQQALLKILEGTVSNVPPQGGRKHPQQEFIQVDTSNILFICGGAFDGIEKIVEKRSGNGGLGFGAEIKSTKELELTEAMQNVIPQDLVKYGLIPELVGRIPVLTTLDDLDEDALVRILKEPKNSLVKQYQELFRMDNVELELDDAALRAIAKETLEKKTGARGLRGVMERVLQPLMYESPSDYRIEKITITEDYVLGNSEPLLVRNEAREQPAPLLVAPASAAPQRRNRRGNVS

SEQ ID NO: 2703 - protein, 405 aa, Unknown
  Description of Unknown: uncultivated organism sequence
  Category: MG90 effectors
  Description: MG90-26 effector
MLIQGPDAYICDECVENCRSIIEGGESSKRRQSNRRTPSPRVLPKPQEIKAQLDEYVIGQDEAKIALSVAVYNHYKRIYRRHRVDVELVKSNILLLGPTGVGKTLLAQTLAKTLDVPFAIADATTLTEAGYVGEDVENILLRLIQAADYDVEKAQRGIIYVDEIDKIARKSENPSITRDVSGEGVQQALLKILEGTVANVPPQGGRKHPQQEFIQIDTSNILFICGGAFDGIEKIVEKRLGNKVLGFGSELQSKSEFEADTVMTKVIPADLVKFGLIPELVGRMPVLTALRNLDENALVKILTEPKNALIKQYKGLFSIDNVELDFEDDALKLIAKTALESKTGARGLRAIMERILLPVMFTTPSDPSIEKITITADCVKNAGMPEIEKNPARLAPKNLPADTTA

SEQ ID NO: 2704 - protein, 427 aa, Unknown
  Description of Unknown: uncultivated organism sequence
  Category: MG90 effectors
  Description: MG90-27 effector
MEKSKLDVVCSFCGKKIPSDVMVAQGIDEDTFICQHCLIALEETFRAADTLIENEEEEHKKDDKKHKRLPRPSEIKAHLDQYIIGQEYAKKVLSVAVYNHYKMLGVKFGNKAVNKDVELEKSNVLLAGPSGSGKTAILKALAKFLKVPFVIADSTEYTSAGYVGKDVECIARDMISAANGDIKKAERGIVYIDEIDKTSRKGENLSTTSDPGHEGTQQALLKLLEGTMLDVPMDGRRLNPESRNVQKISTENMLFIVGGAFEGIEKIIAKRKRQGQNTMGIGAKLVDRKNDKYNDFIEDLATEDLKKFGMLPELLGRVPVIAPLKELTEDQLVQILHEPKNALVKQYQELFIQDGIQLEVTENAMKAIARKAIKRKTGARGLRGIMENILNPVMFSAPDKDIDYVLVDAEDDEIKIKGKKRKVKEAV

SEQ ID NO: 2705 - protein, 475 aa, Unknown
  Description of Unknown: uncultivated organism sequence
  Category: MG90 effectors
  Description: MG90-28 effector
MKDYEEELKDTKDGSGKNENKEDYEDICYICRRPESKVGKLIHLPMEGICICPDCMQRSFTAMSNTNINYEDLMRNMNLQDMFPGNIQDGIPKSQRLKKKKPKDKNEPAIDLKQILPPHQIKARLDDYVIGQDYAKKVMSVAVYNHYKRVATNTMDEIEIEKSNMLMIGPTGCGKTYLVRTLARLLDVPLAIADATSLTEAGYIGDDIESVVSKLLAAADNDVEKAERGIIFIDEIDKIAKKKNTTSRDVSGESVQQGLLKLLEGSDVEVPVGASSKNAMVPLTTVNTRNILFICGGAFPDLEGIIKARLNKTSGIGFGAALNDAHDQDPDIMSRVTIDDLREFGMIPEFIGRLPVIFTLKGLDEEALVKILKEPKNAIIKQYQKLLALDEVDLQFDDGALEAIAKRAIEKKTGARALRSIIEELMLDIMYQIPKDDNIGRVTITQPYVEHTGGPLIEMRGVFSLPNKTPAVGIE

SEQ ID NO: 2706 - protein, 427 aa, Unknown
  Description of Unknown: uncultivated organism sequence
  Category: MG90 effectors
  Description: MG90-29 effector
MEKEGKIYCDFCGKEIEPGEFGATGINGVFICQDCLKEFHESVMAQDTYLESEKKKQEREEVEKEDFQIPRPSMIKAHLDKYIEGQDYAKRVLSVAVYNHYKMLRAKHSGEYNNKDVELEKSNILLCGPTGSGKTAVLRALSKYLKVPFTMADITSYSSAGYVGKDVETIIRDLIVAADGDVKAAERGIVYIDEIDKTSRKGENLSTTSDPGHEGVQQALLKLLEGQMVEVPNKGRRLHPESNNTTMVNTANILFIVGGAFEGIEKIVSQRLHQHSSSMGFGAKLEDKKNDQYNDFIEKVTTEDFRKFGMLPELLGRVPVIAPMKQLSEEQLVHILYRPKNALVKQYQELLSQDNVDLKFTQKALKSIAHDAIKRKTGARGLRGIMEDILNPVMFEVPDKDVDAVVVDADDDDKIKIEYKDLKKEAV

SEQ ID NO: 2707 - protein, 416 aa, Unknown
  Description of Unknown: uncultivated organism sequence
  Category: MG90 effectors
  Description: MG90-30 effector
MSDELENLRCNFCGFKADLEEGIILIKGLDDVCICSECAEECVAIAEEENKIDSEKEMNLDVKPSEIKAYLDKYIIGQNYAKETLSVAVFNHYKMLKYKQQKKQAVELEKSNVLILGPTGTGKTYILRTLANFLNVPFAISDATSLTEAGYVGEDVENVVRRLIDAADGDIERAQTGIIYIDEVDKLTRKGENVSITRDVGGEGVQQAILKMVEGSLVEVPPQGGRKHPQQECAKIDTSNILFIIGGSFEGIDKIISKRQTKDSTIGFGGQIIDKKETSINEVIESVTVDDLKKFGMIPELLGRFPVIAPLKELDNNALQSILTEPKNALVKQYQELFKMDGIKLTFRKDALKAIAQLAQERKTGARALRGIMEDVLHKHMYSLPDDSTIKEVIITEDVVLKKSDPEIKRKKEQAS

SEQ ID NO: 2708 - protein, 419 aa, Unknown
  Description of Unknown: uncultivated organism sequence
  Category: MG90 effectors
  Description: MG90-31 effector
MISTIFINKGEFIMAKNNEFCCMCGSKKDEVDKLIRGKYGYICDSCISIASDLLNDEEEENITNNMQLATPSQIKAHLDQYVIGQDEAKRTLAVAVYNHYKRLKQNKKSDVEIQKSNILMIGSTGSGKTLIAQSLAKFLGVPFAIADATTLTEAGYVGDDVEVMLRTLLQNANYDIESAQRGIIYIDEIDKISRKGENVSITRDVSGEGVQQALLKIIEGTISEVPVTGSRKHPQAETIKIDTSNILFICGGAFDGIDKIIGKEETHNSIGFGANVADKKESVADLSKVEQHDLVKYGLMPELIGRLPIITALNPLSEEDLVHILTEPKNAITKQYQELLSMDGVKLEFEGEALRKISELAIKKKTGARGLRSIIESAMQKVMFDVPDMASVKKVVVTADCVEGKADALVYGARNKKIA

SEQ ID NO: 2709 - protein, 428 aa, Unknown
  Description of Unknown: uncultivated organism sequence
  Category: MG90 effectors
  Description: MG90-32 effector
MAKQEPQHIKCSLCQRDITVHDQYDLPIYDPRSGFAICKSCIREIYHFIEENDHQEAIVQQKDFAMTLDAKLAKIKPHIIKQYLDEYIINQERAKKILSVAVYNHYKRMKYSYLHEDETEIEKSNVIMLGPSGCGKTALLSHLATLLDIPFAVTDASSLTEAGFVGADVEVAVRNLYYAADKNTEKAEHGIIYLDEFDKIARKSGENNSITADPGHEGVQQALLKMLEGSVVEFTARGQRKHPEAPTIKVDTRNILFIVGGAFVGIEKIIAKRLKNTDTNIGFGAKVPSKEEKPKFDELIHKVRPEDLMKFGIIPEIIGRLPVICTLETLDEDALLRILTEPKNAPVKQYEKLLAMDNVQLEFSDTALRAVARKAIERKTGARSLKGIIEDVMLDIMFDIPKSDAKRKVTITEECLEKGENPKIEEIA

SEQ ID NO: 2710 - protein, 410 aa, Unknown
  Description of Unknown: uncultivated organism sequence
  Category: MG90 effectors
  Description: MG90-33 effector
MLETQIPPRRCSFCGKESAEVEALITGPKGVAICNFCVDECYEMIHSQVQEEKNIGEPANLPTPKEIKEFLDQYAIGQDEAKKVLSVAVYNHYKRIFSQTSSDDVDIEKSNILLIGPTGSGKTLLARSLAKLLDVPFAIADATTLTEAGYVGEDVENILLRLLQNADMDVEKAERGIIYIDEIDKIGRKSENSSITRDVSGEGVQQALLKILEGTVANVPPQGGRKHPQQQYIQIDTSNILFICGGAFVGLEDIIAKRIGKGTMGFNADLNKKKLERDELFQHVEPEDLVRFGLIPELIGRLPVIATLSELREEDLVKILNEPKNALVKQYKKLLDLEGVELEFTEEALREIAKEAIKRKTGARGLRAIMEKIMMDVMFEVPTKKNIKKVIIDNEAVLEGKPKYKLAKAS

SEQ ID NO: 2711 - protein, 474 aa, Unknown
  Description of Unknown: uncultivated organism sequence
  Category: MG90 effectors
  Description: MG90-34 effector
MKDYEEVKDTKDITEETEHKDDYEDVCYLCRRPESKVGKLIRLPMEGICICPDCMQRSFTMMGNTNINYEDLMKNMNLQDMFPGNIQDGIPKSQRLKKKKPKEKNEPVIDLKQILPPHQIKARLDDYVIGQDYAKKVMSVAVYNHYKRVATNTMDEIEIEKSNMLMIGPTGCGKTYLVRTLARLLDVPLAIADATSLTEAGYIGDDIESVVSKLLAAADNDVEKAERGIIFIDEIDKIAKKKNTTSRDVSGESVQQGLLKLLEGSDVEVPVGASSKNAMVPLTTVNTRNILFICGGAFPDLDGIIKARLNKTSGIGFGAMLSDAHDQDSDIVSQVTIDDLREFGMIPEFIGRLPVIFTLKGLDEAALVKILKEPKNAIIKQYQKLLALDEVDLQFDDGALEAIAKRAIEKKTGARALRSIIEELMLDIMYQIPKDDNIGRVTITQPYVEHRGGPLIEMRGIFSLPNKTPVAGIE

SEQ ID NO: 2712 - protein, 359 aa, Unknown
  Description of Unknown: uncultivated organism sequence
  Category: MG90 effectors
  Description: MG90-35 effector
MTPAEIKEGLDQYVIGQDEAKRVLSVSVYNHYKRILSGKGGDVELQKSNVLLLGPSGVGKTLLAQTLAKMLGVPFAIADATTLTEAGYVGEDVENILLKLIQAADFDVQKAQIGIIYIDEIDKITRKSENPSITRDVGGEGVQQALLKILEGTVSNVPPQGGRKHPQQEFIQIDTTNILFICGGAFDGLDKYILRRTDKSALGFGSALKDNSTEAERALLRKVEPHDLVKFGLIPELIGRLPVITVLDDLDEDALVRVLKEPRNSLVKQYKELLGMDNVELTFTDEALHAIARKTIERKTGARGLRSVMESILLPIMYEVPSDATIIRVTVDEDTVEGGEAHLEYGAVRKRYKNQAALS

SEQ ID NO: 2713 - protein, 428 aa, Unknown
  Description of Unknown: uncultivated organism sequence
  Category: MG90 effectors
  Description: MG90-36 effector
MAKQEPQHIKCSLCQRDITVHDQYDLPIYDPRSGFAICKSCIREIYHFIEENDHQEAIVQQKDFAMTLDAKLAKIKPHIIKQYLDEYIINQERAKKILSVAVYNHYKRMKYSYLHENETEIEKSNVIMLGPSGCGKTALLSHLATLLDIPFAVTDASSLTEAGFVGADVEVAVRNLYYAADKNTEKAEHGIIYLDEFDKIARKSGENNSITADPGHEGVQQALLKMLEGSVVEFTARGQRKHPEAPTIKVDTRNILFIVGGAFVGIEKIIAKRLKNTDTNIGFGAKVPSKEEKPKFDELIHKVRPEDLMKFGIIPEIIGRLPVICTLETLDEDALLRILTEPKNAPVKQYEKLLAMDNVQLEFSDTALRAVARKAIERKTGARSLKGIIEDVMLDIMFDIPKSDAKRKVTITEECLEKGENPKIEEIA

SEQ ID NO: 2714 - protein, 411 aa, Unknown
  Description of Unknown: uncultivated organism sequence
  Category: MG90 effectors
  Description: MG90-37 effector
MFETNIPERRCSFCGKAQSEVEALITGPKGVAICNQCVDECYKLLHEKEERKKGAPVKVEKLPTPKEIKEFLDQYVIGQEEAKKVLSVAVYNHYKRIMSGGNVDDVELEKSNILLIGPTGSGKTLLARSLAKLLDVPFAIADATTLTEAGYVGEDVENILLRLIQAADYDIEKAERGIIYIDEIDKIARKSENPSITRDVSGEGVQQALLKILEGTIANVPPQGGRKHPHQQYIQIDTSNILFICGGAFVGLEDIIARRIGKGAMGFTADVDKKKMERDELLKHVEPDDLVKFGLIPELIGRLPVIATLKELTEEDLVRVLTEPKNALVKQYKKMLELEGVELEFTEDALREIAREAIRRKTGARGLRAIMEKIMTDVMFEVPTRKDIKKVIIDAESVKTGKPKYELTKAS

SEQ ID NO: 2715 - protein, 472 aa, Unknown
  Description of Unknown: uncultivated organism sequence
  Category: MG90 effectors
  Description: MG90-38 effector
MSDYLDKNTEEKDKDKEYEDICYVCRRPESKAGKMIHLPINNICVCADCMQKSFDTMNKGGFNYSDMMNLNQLNNLNFQELLGMPVMNSGEDPIPQSQKLKKKKPKEEQAPALDIRDIPKPHVIKAQLDDYIIGQEYAKKVVSVAVYNHYKRVATNTMDDIEIEKSNMLMIGPTGCGKTYLVRTLAKLLDVPLAITDATTLTEAGYIGDDVESVVSKLLANADNDVEKAERGIIFIDEIDKIAKKKNTTSRDVSGESVQQGLLKLLEGSDIEVPVGASSKNAMVPMTTVNTRNILFICGGAFPDLENIIKERLTKQSSIGFIADLKDKYDNEENLISKVTIEDLRKFGMIPEFIGRLPVIFTLQGLTKDMLVKILKEPKNAILKQYQKLLALDEVDLQFEDGALEAIAEKALEKKTGARALRSIIEEFMLDIMYEIPKDDNIGRVTITRDYIENTGGPRIEMRGASALPMHS

SEQ ID NO: 2716 - protein, 406 aa, Unknown
  Description of Unknown: uncultivated organism sequence
  Category: MG90 effectors
  Description: MG90-39 effector
MAKNNEYCCMCGSRKDEVEKLIRGKYGYICDSCISIASDLINDEEEESITNNMQLATPSQIKAHLDQYVIGQDEAKRTLAVAVYNHYKRLKQNKKSDVEIQKSNILMIGSTGSGKTYLAQSLAKFLGVPFAITDATTLTEAGYVGDDVEVMLRTLLQNANYDIESAQRGIIYIDEIDKISRKGENMSITRDVSGEGVQQALLKIIEGTISEVPVTGSRKHPQADTIKIDTSNILFICGGAFDGIDKIIGKEETHNSIGFGANVTDKKESVADLSKVEQHDLVKYGLMPELIGRLPIITALNPLSEDDLVRILTDPKNAITKQYQELLSMDGIKLEFEDEALRKIAELAIKKKTGARGLRSIIESAMQKVMFDVPDMSSAKKVVVTAACVEGKADALVYGARNKKIA

SEQ ID NO: 2717 - protein, 418 aa, Unknown
  Description of Unknown: uncultivated organism sequence
  Category: MG90 effectors
  Description: MG90-40 effector
MEERDIIVSMTAAGNNNQTVRYNYRLYPTKTQEAVLNRLFGCCRVVYNDTIDFFNNNFNPNNQSKLPTAANASKQILTNAKKTTKRAFLKEVSSVALQQELRNAWLACLHGVSHSSNQKPAKRKTKKHNPVNSANFTSNGFSINQHGVYISKIGVIKTKWSRPMPSEPTSCTISHARNGRWYASFVVKRPKTPFAQCDNNAGIDMGLTDMATIVNTKGKRWKIENPRNYAKIQDKIGRLQRHLSKQTKGSKRYERTRHQIALLYSKAHDALADYQWKNVLNIIRETQAIGVETLDIKSMAVKHGKSVRDASMRSFLNKLGSKADEHCRVIIQLNQWLVTTKVCALCKHKLKVGLPEYARHWVCPKCGAHLDRDYNAALNILDAAGLAGSLNARGGSVRSFLVSAENGCSRGTAYHPNF

SEQ ID NO: 2718 - protein, 439 aa, Unknown
  Description of Unknown: uncultivated organism sequence
  Category: MG90 effectors
  Description: MG90-41 effector
MIDWGLQQHVTSKLTVPKPKDIKAKLDEYIVKQDHAKKVLAVAVHNHYKRIMSPAKDGIELGKSNILLIGPTGTGKTLLAQTLAKILDVPFAMADATSLTEAGYVGDDVENVVLNLVNAADGDIERACRGIIYIDEIDKIAKKGENPSITRDVSGEGVQQSLLKMIEGTVAAVPPKGGRKHPQQEFLRVDTTNILFICGGAFVGLADIIDKRTSLGSMGFNANVVNKDKRDLSALYHALEPEDLLKFGLIPELVGRLPVVATLEPLDEAALTEILTEPKNSLVKQYKKMFKIDGVDLEFDDDALAEIAKLAIKKESGARGLRSILENAMMPFLYAVPGMPNMKKLVITRDIIAKQGDLSQIDELNARYNAKQDDKSSNASTKTSDAESDDATSDDAKSGSDQSDDKSISSDDTIDDKSSNADDKKAKSARAKKTKKTDP

SEQ ID NO: 2719 - protein, 442 aa, Unknown
  Description of Unknown: uncultivated organism sequence
  Category: MG90 effectors
  Description: MG90-42 effector
MAENKDMTPDNSVEEKETIVCDFCGRRQKDPKDPVYGSRDGKSWICGECISTIHKVMNTKDTTVERIKAGAAASSPQKINIGTPAKIKAYLDQYIEGQEYAKRVLSVAVYNHYKMLKIKHRQEKSGEPPKVELEKANTIIIGPTGCGKTAIIRHLAKKLGVPFIITDATLYTSSGYVGSDVETIIRDLVKAAGGDVEAAQRGIVYIDEIDKTGRKGENLSTTSDPGHEGAQQALLKLLEGTMLEVPVGNNRKHPNAETFMVNTENILFIIGGSFEGIEKIIAKRLRDESGAGKIGFGSKLVDEKNKLFNEYIEKVTVDDLKKFGMLPELLGRVPVVAPMKELTEDQLMSILYRPKNALVKQYQELFAHDGVTLTVTEGAMRAIAQMAIRRKTGARGLRGIMETILNPVMFELPERSENAVLVDVVDGKINVAYEDKEEREAV

SEQ ID NO: 2720 - protein, 448 aa, Unknown
  Description of Unknown: uncultivated organism sequence
  Category: MG90 effectors
  Description: MG90-43 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPKNALIKQFKELFAMEGVELEVTADALKAIAHKAMERKTGARGLRSIVEAALLDAMFEVPAKPEIGRVVLDKATIETGAPVDMIACPRKDPVKPEASQAS

SEQ ID NO: 2721 - protein, 413 aa, Unknown
  Description of Unknown: uncultivated organism sequence
  Category: MG90 effectors
  Description: MG90-44 effector
MNKVNDKMQKCSFCGAMASESDDNVLIQSENENSFICIDCIDTISLKMQKFKKKKAAIMSKKNLELSSLTPKRIKQFLDDYIIGQEEAKKIISVAVYNHYKSISIKERDPEIELEKSNIIMLGPSGCGKTAVVKALSKMLNVPFAIADASTLTAAGYVGSDVEVVLQRLLSSADNNVEEAQKGIVYIDEIDKISRKGENLSTTADPGHEEVQQALLKIIEGSIVDVPQKGNRKHPHGENIKMDTSNILFIVGGAFEGIEKIVAKRQKKGKTKIGFGSELKDDEKTYNELVNNVKVEDLKKFGMIPELLGRLPIICTMKELDENALIKILTEPKNALIKQYKRLLQEDGVELNVSDLALKAIANRAKERKTGARSLRSILEEILNPTMFDLPEKEVNQITLDINNNDFVVNYNK

SEQ ID NO: 2722 - protein, 407 aa, Unknown
  Description of Unknown: uncultivated organism sequence
  Category: MG90 effectors
  Description: MG90-45 effector
MANKNNEFCCMCGSKKDEVDKLIRGKYGYICDSCISIANDLLNDEEEESITNNMQLGTPSQIKAHLDQYVIGQDEAKRTLAVAVYNHYKRLKQNKKSDVEIQKSNILMIGSTGSGKTYLAQSLAKFLGVPFAIADATTLTEAGYVGDDVEVMLRTLLQNANYDIQAAQRGIIYIDEIDKISRKGENMSITRDVSGEGVQQALLKIIEGTVSEVPVTGSRKHPQAETIKIDTSNILFICGGAFDGIDKIIGKEETHNSIGFGANVADKKESITDLSKVEQHDLVKYGLMPELIGRLPIITALNPLSEDDLVHILTEPKNAITKQYQELLSMDGVKLEFEDEALRKIAELAIQKKTGARGLRSIIESAMQKVMFDVPDMSSAKKVVVTAACVEGKADALVYGARNKKIA

SEQ ID NO: 2723 - protein, 448 aa, Unknown
  Description of Unknown: uncultivated organism sequence
  Category: MG90 effectors
  Description: MG90-46 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKFGIGFSAQVKSEKEASLSELLQDVEPSDLVKYGLIPELVGRLPVIAVLQELTEEGFVSILTEPRNALIKQFKELFAMEGVELEVTADALKAIAHKAMERKTGARGLRSIVEAALLDAMFEVPAKPEIGRVVLDKATIETGAPVDMIACPRKDPVKPEASQAS

SEQ ID NO: 2724 - protein, 361 aa, Unknown
  Description of Unknown: uncultivated organism sequence
  Category: MG90 effectors
  Description: MG90-47 effector
MHDSQGNRLRFEDLPKPAEIKAKLDEYIVGQDRAKVVLSVAVYNHYKRILYAGDNDVELQKSNILLIGPTGSGKTLFAQSLAKMLNVPFAIADATTLTEAGYVGEDVENILLRLLQAADFDVERAEKGIIYIDEIDKIARKSENTSITRDVSGEGVQQALLKLLEGTVANVPPQGGRKHPHQEFIKVDTTNILFICGGAFDGLDKIIEKRTEKKSMGFGADIKSSTERDVGELLKQAQQHDLLKFGIIPELIGRLPVIAPLTSLKREDLVRILTEPKNAMTKQYEALMAYDGVELVYEKDALEAVADKAIEMKIGARGLRSVMEGIMTDIMYTVPSEHDIEKVIVTADCVKNGTGPDVIRK

SEQ ID NO: 2725 - protein, 442 aa, Unknown
  Description of Unknown: uncultivated organism sequence
  Category: MG90 effectors
  Description: MG90-48 effector
MSDTKERCSFCGKEESDDRLLIGSEDGCAFICKHCFDRLKDEFADETLLKEESLNWKDLTPSKIKSYLDKYIIGQDRAKKVLSVAVYNHYKMLDYAKQQSDVELEKSNIIMVGPTGVGKTAIIKALAKILNVPFAITDATTLTENGYVGADPECCVQRLLYAADGDVDKTETGIIYIDEIDKIACKGENMSITRDVSGEGVQQALLKIIEGTIVDVPEKGVRKHPNAETIRVDTSKILFIVGGAFPGLEKIIKKRKKISNKAKIGFADGNAEKTAEEVTYNEVIDDVSPEDLKKFGIIAELLGRLPIITPLHELTEDQLCQILTEPKNALVRQYTEIFKYDDTDLVFEKDALKSIAARAIKNGTGARGLRAILESLLLDKMYEIPDLKQKNTLTITKQYVESKNAKEVSKHNGTGKQTVSTVLRRRQKPGESGTGCPDVAKS

SEQ ID NO: 2726 - protein, 373 aa, Unknown
  Description of Unknown: uncultivated organism sequence
  Category: MG90 effectors
  Description: MG90-49 effector
MVSNAPEPEEEIIDLPKPSEIKAYLDQYVIGQEEAKMIISVAVYNHYKRIFSQKKDDDIDLEKSNILMIGPTGCGKTLIAETLARFLKVPFAISDATTLTEAGYVGEDVENILVRLLQAADYDVAKAEKGIVYIDEIDKISRKSETPSITRDVSGEGVQQALLKILEGTKVNVPPKGGRKHPQQDFIEMDTKNILFIAGGAFFGLEKIIKERIDKKAIGFDVKLGTNIDEANIFDQTISQDLLKYGLIPELIGRMPVLCTLHELTEEALVEILVKPKNALCSQYKKYFELDGVELEFGEDALREIARIAINQKTGARGLRSIMEKFMLKIMYNIPDLDNIRSCHITADVVSKGEEPEFVFSSKSSNKRAAITR

SEQ ID NO: 2727 - protein, 394 aa, Unknown
  Description of Unknown: uncultivated organism sequence
  Category: MG90 effectors
  Description: MG90-50 effector
MKYCTVLEWCRSRKRDSEQAPKDLEDIRLMPPTEIKKVLDEYVIGQDMAKISLAVSVYNHYKRILSQEDDEDEVELQKSNVLLLGPTGVGKTFLAQTLAKILDVPFAIADATTITEAGYVGDDVENVLLRLLQAADFDVEAAERGIIYIDEIDKISRKSENVSLTRDVSGEGVQQALLKIVEGTVSNVPPQGGRKHPNQECIQVNTKNILFICGGAFDGLEKIIQKRQSPSGLGFGAPVAQSKKELSNIFRQAIPQDLVKFGLVPELVGRLPVITTLDDLDEDALIRILTEPKNALVKQYQKLFSYDEIELELEPNALRGIAKKAIERKTGARGLRSIMEGILMETMYQVPQMESVARVVITADCVEGTKKPTLLAKDGTEIPYPESESKAINA

SEQ ID NO: 2728 - protein, 359 aa, Unknown
  Description of Unknown: uncultivated organism sequence
  Category: MG90 effectors
  Description: MG90-51 effector
MTPAEIKDGLDQYVIGQDEAKRVLSVSVYNHYKRILSGKGGDVELQKSNVLLLGPSGVGKTLLAQTLAKMLGVPFAIADATTLTEAGYVGEDVENILLKLIQAADFDVQKAQIGIIYIDEIDKITRKSENPSITRDVGGEGVQQALLKILEGTVSNVPPQGGRKHPQQEFIQIDTTNILFICGGAFDGLDKYILRRTDKSALGFGSSLKDNSSEAERALLRKVEPHDLVKFGLIPELIGRLPVITVLDDLDEDALVRVLKEPRNSLVKQYKELLGMDNVELTFTDEALHAIARKTIERKTGARGLRSVMESILLPIMYEVPSDATIIRVTVDEDTVEGGEAHLEYGAVRKRYKNQVALS

SEQ ID NO: 2729 - protein, 448 aa, Unknown
  Description of Unknown: uncultivated organism sequence
  Category: MG90 effectors
  Description: MG90-52 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPRNALIKQFKELFAMEGVELEVTADALKAIAHKAMERKTGARGLRSIVEAALLDAMFEVPAKPEIGRVVLDKATIETGAPVDMIACPRKDPVKPEASQAS

SEQ ID NO: 2730 - protein, 377 aa, Unknown
  Description of Unknown: uncultivated organism sequence
  Category: MG90 effectors
  Description: MG90-53 effector
MKSAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPRNALIKQFKELFAMEGVELEVTAGALKAIAHKAMERKTGARGLRSIVEAALLDAMFEVPAKPEIGRVVLDKATIETGAPVDMIACPRKDPVKPEASQAS

SEQ ID NO: 2731 - protein, 407 aa, Unknown
  Description of Unknown: uncultivated organism sequence
  Category: MG90 effectors
  Description: MG90-54 effector
MANKNNEYCYMCGSKKDEVDKLIRGKYGYICDSCISIASELLNDEEEESITNNMQLATPSQIKAHLDQYVIGQDEAKRTLAVAVYNHYKRLKQNKKSDVEIQKSNILMIGSTGSGKTLIAQSLAKFLGVPFAIADATTLTEAGYVGSDVETMLRTLLQNADYDIQAAQRGIIYIDEIDKISRKSENVSITRDVSGEGVQQALLKIIEGTVSEVPVTGGRKHPQAETIKIDTSNILFICGGAFDGIDKIIGKEETHNSIGFGANVSDKKESVTDLSKVEQHDLVKYGLMPELIGRLPIITALNPLSEEDLVHILTEPKNAITKQYQELLSMDGVKLEFEDEALRKIAELAIKKKTGARGLRSIIEGSMQKIMFEIPDMSIAKKVVVTAACVEGKADALVYGARNKKIA

SEQ ID NO: 2732 - protein, 448 aa, Unknown
  Description of Unknown: uncultivated organism sequence
  Category: MG90 effectors
  Description: MG90-55 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEESLSELLQDVEPSDLVKYGLIPELVGRLPVIAVLQELTEEGFVSILTEPRNALIKQFKELFAMEGVELEVTADALKAIAHKAMERKTGARGLRSIVEAALLDAMFEVPAKPEIGRVVLDKATIETGAPVDMIACPRKDPVKPEASQAS

SEQ ID NO: 2733 - protein, 448 aa, Unknown
  Description of Unknown: uncultivated organism sequence
  Category: MG90 effectors
  Description: MG90-56 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPRNALIKQFKELFAMEGVELEVTAGALKAIAHKAMERKTGARGLRSIVEAALLDAMFEVPAKPEIGRVVLDKATIETGAPVDMIACPRKDPVKPEASQAS

SEQ ID NO: 2734 - protein, 411 aa, Unknown
  Description of Unknown: uncultivated organism sequence
  Category: MG90 effectors
  Description: MG90-57 effector
MFETKVPLRRCSFCGRDQTKVEALITGPGGVAICNYCIDECYEMIHQEREKKENSPVSIDRLPTPREIKEFLDQYVIGQDEAKKVLSVAVYNHYKRIMSGKDTDDVEIEKSNILLIGPTGSGKTLLARSLAKLLDVPFAIADATTLTEAGYVGEDVENILLRLIQAADYDIEKAERGIIYIDEIDKISRKSENPSITRDVSGEGVQQALLKILEGTIANVPPQGGRKHPHQQYIQIDTTNILFICGGAFVGLEDIIARRIGKGSMGFTADVDKKKLNRDELLKHVEPDDLVKFGLIPELIGRLPVIATLSELKEEDLVRVLKEPKNSLVKQYKKLLELEGVELEFTDDALRAIAKEAIRRKTGARGLRAIMEKIMTDVMFEVPTRKDVRKVIIDAESVKTGKPKYELVKAS

SEQ ID NO: 2735 - protein, 474 aa, Unknown
  Description of Unknown: uncultivated organism sequence
  Category: MG90 effectors
  Description: MG90-58 effector
MKDYEEVKDTKDITEETEHKDDYEDVCYLCRRPESKAGKLIRLPMEGICICPDCMQRSFTMMGNTNINYEDLMKNMNLQDMFPGNIQDGIPKSQRLKKKKPKEKNEPVIDLKQILPPHQIKARLDDYVIGQDYAKKVMSVAVYNHYKRVATNTMDEIEIEKSNMLMIGPTGCGKTYLVRTLARLLDVPLAIADATSLTEAGYIGDDIESVVSKLLAAADNDVEKAERGIIFIDEIDKIAKKKNTTSRDVSGESVQQGLLKLLEGSDVEVPVGASSKNAMVPLTTVNTRNILFICGGAFPDLDGIIKARLNKTSGIGFGAMLSDAHDQDSDIVSQVTIDDLREFGMIPEFIGRLPVIFTLKGLDEAALVKILKEPKNAIIKQYQKLLALDEVDLQFDDGALEAIAKRAIEKKTGARALRSIIEELMLDIMYQIPKDDNIGRVTITQPYVEHRGGPLIEMRGIFSLPNKTPVAGIE

SEQ ID NO: 2736 - protein, 448 aa, Unknown
  Description of Unknown: uncultivated organism sequence
  Category: MG90 effectors
  Description: MG90-59 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEESLSELLQDVEPSDLVKYGLIPELVGRLPVIAVLQELTEEGFVSILTEPRNALIKQFKELFAMEGVELEVTSGALKAIAHKAMERKTGARGLRSIVEAALLDAMFEVPAKPEIGRVVLDKATIETGAPVDMIACPRKDPVKPEASQAS

SEQ ID NO: 2737 - protein, 448 aa, Unknown
  Description of Unknown: uncultivated organism sequence
  Category: MG90 effectors
  Description: MG90-60 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEESLSELLQDVEPSDLVKYGLIPELVGRLPVIAVLQELTEEGFVSILTEPRNALIKQFKELFAMEGVELEVTAGALKAIAHKAMERKTGARGLRSIVEAALLDAMFEVPAKPEIGRVVLDKATIETGAPVDMIACPRKDPVKPEASQAS

SEQ ID NO: 2738 - protein, 448 aa, Unknown
  Description of Unknown: uncultivated organism sequence
  Category: MG90 effectors
  Description: MG90-61 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPRNALIKQFKELFAMEGVELEVTAGALKAIAHKAMERKTGARGLRSIVEAALLDAMFEVPAKPEIGRVVLDKATIETGAPVDMIVCPRKDPVKPEASQAS

SEQ ID NO: 2739 - protein, 448 aa, Unknown
  Description of Unknown: uncultivated organism sequence
  Category: MG90 effectors
  Description: MG90-62 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPRNALIKQFKELFAMEGVELEVTADALKAIAHKAMERKTGARGLRSIVEAALLDAMFEVPAKPEIGRVVLDKATIETGAPVDMIACPRKDPVKPEASQAF

SEQ ID NO: 2740 - protein, 448 aa, Unknown
  Description of Unknown: uncultivated organism sequence
  Category: MG90 effectors
  Description: MG90-63 effector
MFDKKKTDDLRCSICGRHKNDTEVLVDTGQGILICDRCVKGLMKAMGIEAPAKSPADATVATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPRNALIKQFKELFAMEGVELEVTADALKAIAHKAMERKTGARGLRSIVEAALLDAMFEVPAKPEIGRVVLDKATIETGAPVDMIACPRKDPVKPEASQAS

SEQ ID NO: 2741 - protein, 448 aa, Unknown
  Description of Unknown: uncultivated organism sequence
  Category: MG90 effectors
  Description: MG90-64 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEESLSELLQDVEPSDLVKYGLIPELVGRLPVIAVLQELTEEGFVSILTEPRNALIKQFKELFAMEGVELEVTAGALKAIAHKAMERKTGARGLRSIVEAALLDAMFEVPAKPEIGRVVLDKATIETGAPVDMIVCPRKDPVKPEASQAS

SEQ ID NO: 2742 - protein, 448 aa, Unknown
  Description of Unknown: uncultivated organism sequence
  Category: MG90 effectors
  Description: MG90-65 effector
MFDKKKTDDLRCSICGRHKNDTEVLVDTGQGILICDRCVKGLMKAMGIEAPAKSPAAASAATGSEAVAAGEMKSAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEESLSELLQDVEPSDLVKYGLIPELVGRLPVIAVLQELTEEGFVSILTEPRNALIKQFKELFAMEGVELEVTAGALKAIAHKAMERKTGARGLRSIVEAALLDAMFEVPAKPEIGRVVLDKATIETGAPVDMIACPRKDPVKPEASQAF

SEQ ID NO: 2743 - protein, 428 aa, Unknown
  Description of Unknown: uncultivated organism sequence
  Category: MG90 effectors
  Description: MG90-66 effector
MAKQEPQHIKCSLCQRDITVHDQYDLPIYDPRSGFAICKSCIREIYHFIEENDHQEAIVQQKDFAMTLDAKLAKIKPHIIKQYLDEYIINQERAKKILSVAVYNHYKRMKYCYLHEDETEIEKSNVIMLGPSGCGKTALLSHLATLLDIPFAVTDASSLTEAGFVGADVEVAVRNLYYAADKNTEKAEHGIIYLDEFDKIARKSGENNSITADPGHEGVQQALLKMLEGSVVEFTARGQRKHPEAPTIKVDTRNILFIVGGAFVGIEKIIAKRLKNTDTNIGFGAKVPSKEEKPKFDELIHKVRPEDLMKFGIIPEIIGRLPVICTLETLDEDALLRILTEPKNAPVKQYEKLLAMDNVQLEFSDTALRAVARKAIERKTGARSLKGIIEDVMLDIMFDIPKSDAKRKVTITEECLEKGENPKIEEIA

SEQ ID NO: 2744 - protein, 372 aa, Unknown
  Description of Unknown: uncultivated organism sequence
  Category: MG90 effectors
  Description: MG90-67 effector
MVSNAPEPEEEIIDLPKPSEIKAYLDQYVIGQEEAKMIISVAVYNHYKRIFSRKDDDIDLEKSNILMIGPTGCGKTLIAETLARFLKVPFAISDATTLTEAGYVGEDVENILVRLLQAADYDVAKAEKGIVYIDEIDKISRKSETPSITRDVSGEGVQQALLKILEGTKVNVPPKGGRKHPQQDFIEMDTKNILFIAGGAFFGLEKIIKERIDKKAIGFDVKLGTNIDEANIFDQTISQDLLKYGLIPELIGRMPVLCTLHELTEEALVEILVKPKNALCSQYKKYFELDGVELEFGEDALREIARIAINQKTGARGLRSIMEKFMLKIMYNIPDLDNIRSCHITADVVSKGAEPEFVFSSKSSNKRAAITR

SEQ ID NO: 2745 - protein, 475 aa, Unknown
  Description of Unknown: uncultivated organism sequence
  Category: MG90 effectors
  Description: MG90-68 effector
MKDYEEEVKDTKDDAGENERKDDYEDICYMCRRPESKAGKLIHLPMEGICICPDCMQRSFTAMTNTNINYEDLMRNMNFQDMFPGNIQDGIPKSQRLKKKKPKENKEPAIDLKAILPPHQIKARLDDYVIGQDYAKKVMSVAVYNHYKRVATNTMDEIEIEKSNMLMIGPTGCGKTYLVRTLARLLDVPLAIADATSLTEAGYIGDDIESVVSKLLAAAGNDVEKAERGIIFIDEIDKIAKKKNTTSRDVSGESVQQGLLKLLEGSDVEVPVGASSKNAMVPLTTVNTRNILFICGGAFPDLEGIIKARLNKTSGIGFEAALNDAHDQDPEIMSQVTIDDLREFGMIPEFIGRLPVIFTLKGLDEKALVKILKEPKNAIIKQYQKLLALDEVDLQFDDEALEAIAKRAIQKKTGARALRSIIEELMLDIMYQIPKDDNIGRVTITEPYVEHTGGPLIEMRGVLTLPNKTPVAGIE

SEQ ID NO: 2746 - protein, 360 aa, Unknown
  Description of Unknown: uncultivated organism sequence
  Category: MG90 effectors
  Description: MG90-69 effector
MDSYVIGQDEAKKVLSVAVYNHYKRVLAGNDLDVELQKSNILMLGPTGSGKTYLAQTLAKILNVPFAIADATTLTEAGYVGEDVENILLKLIQAADYDIEKAQYGIVYIDEIDKITKKSENVSITRDVSGEGVQQALLKILEGTVASVPPQGGRKHPHQELLQIDTTNVLFICGGAFDGLEKIIENRMDQKAIGFNSEITDNTEMNNDALFGEVMPQDLVKFGIIPEFIGRVPVTVALKSLDENALVEILTKPKNAIVKQYEKLFELDGVKLTFTDEALKTIAKKSFERKTGARGLRAIMEQTVLDVMYETPSDETIEECIINEDVVNQLADPELKYKNNLDAKIKRANKKAKNEQIQPA

SEQ ID NO: 2747 - protein, 404 aa, Unknown
  Description of Unknown: uncultivated organism sequence
  Category: MG90 effectors
  Description: MG90-70 effector
MFSGIDGYICDDCVDRCSELLDDENYGWDKEEQFSDINLLKPKEIREFLDQYVIGQDAAKKVLSVAVYNHYKRITSGQKSEVEIQKSNILMLGPTGSGKTYLAQTLARLLNVPFAIADATTLTEAGYVGEDVENILLKLIQAADNNVARAEYGIIYIDEIDKISKKSENVSITRDVSGEGVQQALLKILEGTNASVPPQGGRKHPQQELIPINTTNILFICGGAFDGLEKIIERRLGSGGIGFNSEVVEKHSRGIDELFRQVMPQDLMKFGLIPELIGRVPVTVSLDLLDEDALVRILTEPKNALTKQYKSLFEMDGVKLEFTEDAIREVAHQAVERKTGARGLRAIMEDVMMDIMYEIPSDPSIGICTVTREAVLKQKQPEIVYRDLAAAGRPAGRVSGGVTA

SEQ ID NO: 2748 - protein, 448 aa, Unknown
  Description of Unknown: uncultivated organism sequence
  Category: MG90 effectors
  Description: MG90-71 effector
MFDKKKTDDLRCSICGRHKNDTEVLVDTGQGILICDRCVKGLMKAMGIEAPAKSPADATAATGSEAAAAGEKKTAQEPAAPELEGKLPTPQELYAHLNNYVIGQEKAKRVLSVAVYNHYKRLRHANDDGVELSKSNVLLVGPTGSGKTLLAQTLARGLNVPFAIADATTLTEAGYVGEDVENIIHKLLQAADGNVERAQRGIVYLDEIDKIARKSENPSITRDVSGEGVQQALLKLVEGTLCNVPAAGGRKNPRGQMIAVDTSNILFICGGAFDGLEKIVRRRSVKSGIGFSAQVKSEKEASLSELLQDVEPSDLVKYGLIPELVGRLPVIAVLQELTEEGFVSILTEPRNALIKQFKELFAMEGVELEVTADALKAIAHKAMERKTGARGLRSIVEAALLDAMFEVPAKPEIGRVVLDKATIETGAPVDMIVCPRKDPVKPEASQAS

SEQ ID NO: 2749 - protein, 379 aa, Unknown
  Description of Unknown: uncultivated organism sequence
  Category: MG90 effectors
  Description: MG90-72 effector
MDIIREEHKTTLVKSRDGVPTPRDICTVLDDYVIGQPHAKRVLSVAVHNHYKRLAHGQKNNDVEISKSNILLVGPTGCGKTLLAQTLARIIDVPFTMADATTLTEAGYVGEDVENIILRLLQAADYNVERAQRGIVYIDEVDKISRKSENPSITRDVSGEGVQQALLKIMEGTIASVPPQGGRKHPQQEFLQVDTTNILFICGGAFAGLEKIISQRSRGTSIGFGADVRGVDERQTGEILRGVEPEDLLKFGLIPEFIGRLPVIATLSDLDENTLVEILIRPKNALLKQYQRLFEMEGVHLEFADDALRSVARRAIAHKTGARGLRSIMEGILLDSMFELPTMSGVDEIVINREVVEGRASPLQIYADRRGDNVGGSSA

SEQ ID NO: 2750 - protein, 363 aa, Unknown
  Description of Unknown: uncultivated organism sequence
  Category: MG90 effectors
  Description: MG90-73 effector
MVSPTPVKAGAKAAKPAADSRKKLTPKAIHAYLDQYVIGQDRAKKVLSVAVYNHYKRLENNLDAIDSQVELEKSNILLAGPTGTGKTLLARTIARLLDVPFTIVDATVLTEAGYVGEDVESILSRLLEQADYDVARTERGIVFIDEIDKVARKSDNPSITRDVSGEGVQQAMLKLLEGNVVNVPPKGGRKHPEQDFVHINTQNILFICGGAFEGIERRIAQRLNTQVIGFDSAAKQQVDKENLLQYVSQEDFRAYGLIPEIIGRLPVITYLDPLDEDALKRILVEPKNALIKQYEKMFEMDGKKLVVEPEVLDFIVKTAVEKKIGARGLRSICEKIFTEAMYEAPSSQQAVYTVTLDFARKAI

SEQ ID NO: 2751 - protein, 442 aa, Unknown
  Description of Unknown: uncultivated organism sequence
  Category: MG90 effectors
  Description: MG90-74 effector
MMFQDPTTGTALCFSCAQKMMAMAAAKQRYENNGVSELEREQAAAAKLQLHREEAKQLFEIMSNESPAKIKAHLDKYIIGQDGAKKVLSVAVYNHYKRLAFFEAQKCKELETGKKIEGLAQLDKSNILMLGPTGVGKTAILKAIALYLGVPFTVVDSSTLTQSGYVGSDPETCVRQLWEEAGKDREKTERGIIFLDEFDKIARKSGTNRSTSADPGHEGVQQALLKIVEGTKVHFTLGNRKHPDAQTIEVDTTNILFVCGGAFEGIEKIIAKRVETGNGFGYTHVDKLGLDELKDEADRFNRLIEEATPDDVKEYGIIPEMLGRLPIMCKLHQLKENDLIRILTEPKNAIIKQFAVLFDMDGCRLKPDREALKEIARKAIKTGTGARSLRTIIEGILLDTMYDLPQISEQAAEGTKPVIHLTGEAVKTKKLSVEYVKAPMAA

SEQ ID NO: 2752 - protein, 411 aa, Unknown
  Description of Unknown: uncultivated organism sequence
  Category: MG90 effectors
  Description: MG90-75 effector
MFETNIPERRCSFCGRGQNEVEALITGPKGVAICNVCVDECYKMLHEKEEKRKGAPVKVDRLPTPKEIKEFLDQYVIGQEEAKKVLSVAVYNHYKRIMSGGTVDDVELEKSNILLIGPTGSGKTLLARSLAKLLDVPFAIADATTLTEAGYVGEDVENILLRLIQAADYDIEKAERGIIYIDEIDKIARKSENPSITRDVSGEGVQQALLKILEGTIANVPPQGGRKHPHQQYIQIDTSNILFICGGAFVGLEDIIARRIGKGAMGFTADVDKKKMERDELLKHVEPDDLVKFGLIPELIGRLPVIATLKELSEEDLVRVLTEPKNALVKQYKKMLELEGVELEFTEDALREIAREAIRRKTGARGLRAIMEKLMTDVMFEVPTRKDVKKVIIDAEAVKTGKPKYELTKAS

SEQ ID NO: 2753 - protein, 532 aa, Unknown
  Description of Unknown: uncultivated organism sequence
  Category: MG90 effectors
  Description: MG90-76 effector
MENYHKETHCSFCGKSESEVETIINGPNGMTICNECIETCEYILNKGKSADNSGLSLYTPKEIKAKLDEYIIGQDSAKRVLSVAVYNHYKRISQLGEKKKNDGVVIEKSNVLLLGPTGSGKTLLAKTLAQILNVPFAVADATTLTEAGYVGEDVENILLKLIQSANGDLKRAEIGIVYIDEYIIGQDSAKRVLSVAVYNHYKRISQLGEKKKNDGVVIEKSNVLLLGPTGSGKTLLAKTLAQILNVPFAVADATTLTEAGYVGEDVENILLKLIQSANGDLKRAEIGIVYIDEIDKIAKKGENVSITRDVSGEGVQQALLKIIEGTVANVPPQGGRKHPNQECYQLDTTNILFLCGGAFVDLDKIIDQRKDNSKLGFGSAVKGTVDYRYDELIEALQPADLIKYGLIPEFVGRVPIVVGLNALDENALVKILSEPKNALVKQYKYQFELDGVDLEFEDDALRAVAAKAIQLNTGARGLRAILEDVLLELMFEIPSDGDIEKVIVTKGAIEKTEKPIVVRAQGVKGETANNIA

SEQ ID NO: 2754 - protein, 412 aa, Unknown
  Description of Unknown: uncultivated organism sequence
  Category: MG90 effectors
  Description: MG90-77 effector
MFETKIPERRCSFCGRGQSEVEALITGPKGVAICNLCVDECYKMLHEESERKKKGAPVGVEKLPTPKEIKEFLDQYVIGQEEAKKVLSVAVYNHYKRIMSGGNVDDVELEKSNILLIGPTGSGKTLLARSLAKFLDVPFAIADATTLTEAGYVGEDVENILLRLIQAADYDIEKAERGIIYIDEIDKIARKSENPSITRDVSGEGVQQALLKILEGTIANVPPQGGRKHPHQQYIQIDTSNILFICGGAFVGLEDIIARRIGKGAMGFTADVDKKKMERDELLKHVEPDDLVKFGLIPELIGRLPVIATLKELKEEDLVRVLTEPKNALVKQYQKMLELEGVELEFTEDALREIAKEAIRRKTGARGLRAIMEKLMTDVMFEVPTRKDIKKVIIDAESVKTGKPKYELTKAS

SEQ ID NO: 2755 - protein, 350 aa, Unknown
  Description of Unknown: uncultivated organism sequence
  Category: MG90 effectors
  Description: MG90-78 effector
MKIPTPKELKAFLDEHVIGHDEVKKVLAVAVHNHYRRLEAAFSREANPEFADVEIEKSNILLIGPTGTGKTLLAKTLAKLLGVPFAIGDATVLTQAGYVGEDVENLVRYLYVNAGEDVQLAQTGIIYVDEIDKIASKTDNVSITRDVSGEGVQQALLKIIEGSTCRLPPKGGRKHPDQEYVEVDTRNILFICGGAFVGLDKIVAARTGKHTIGFGGEDSAQADSELIAKDVRPEDLVKFGLIPEFTGRLPIIATMGELTEDQLVDVLTKPKNALVKQYQKLLAMDGVKLEFEEDALRELAKMALKRKTGARGLRAEMERLMTDVMYEAPGNPKLKKVTVTAKLIKEKLCK

SEQ ID NO: 2756 - protein, 411 aa, Unknown
  Description of Unknown: uncultivated organism sequence
  Category: MG90 effectors
  Description: MG90-79 effector
MFETNIPERRCSFCGKAQSEVEALITGPKGVAICNQCVDECYKLLHEKEERKKGAPVKVEKLPTPKEIKEFLDQYVIGQEEAKKVLSVAVYNHYKRIMSGGNVDDVELEKSNILLIGPTGSGKTLLARSLAKLLDVPFAIADATTLTEAGYVGEDVENILLRLIQAADYDIEKAERGITYIDEIDKIARKSENPSITRDVSGEGVQQALLKILEGTIANVPPQGGRKHPHQQYIQIDTSNILFICGGAFVGLEDIIARRIGKGAMGFTADVDKKKMERDELLKHVEPDDLVKFGLIPELIGRLPVIATLKELTEEDLVRVLTEPKNALVKQYKKMLELEGVELEFTEDALREIAREAIRRKTGARGLRAIMEKIMTDVMFEVPTRKDIKKVIIDAESVKTGKPKYELTKAS

SEQ ID NO: 2757 - protein, 402 aa, Unknown
  Description of Unknown: uncultivated organism sequence
  Category: MG90 effectors
  Description: MG90-80 effector
MQTVRYNYRLYPTKTQETVLNRLFGCCRVVYNDTIDFFNNNFNPNNQSKLPTVSKASKQILTNAKKTTKRAFLKEVSSVALQQELRNAWLACLHGVSHSSNQKPAKRKTKKHNPVNSANFTGNSFIVKQHGVYIQKIGVIKTKWSRPMPSEPTSCTISHARNGRWYASFVVKRPKTPFAQCDNNAGIDMGLTDMATIVNTKGKRWKIANPRNYAKLQDKISRLQRHLSKQTKGSKRYERTRHQIALLYSKAHDALADYQWKNVLNIIRETQAIGVETLNIQGMTAKHGKSVRDAAMRSFLNKLGSKAEEHCRIIIQLNQWLATTKVCALCKHKLKAGIPEYARHWVCPNCGAHLDRDYNAALNILDAAGLAGSLNARGGGVRSFLASAENGCSRRTAYHPSF

SEQ ID NO: 2758 - protein, 394 aa, Unknown
  Description of Unknown: uncultivated organism sequence
  Category: MG90 effectors
  Description: MG90-81 effector
MEEGSADKGHVTIVYPAYPNVGQERELLRTLGVVRGLYNHFLAESIADVMEGDRFPTPREMNKAITVMRGRDIGLGSVAVFTLRDAPLRVHAAMTSFAKLSARSGELRLPRFKSESRYRSLAFDPKGVKFDGRRIVFGKWVKLRCGNLDRNRKLHRPEGGRIVTARIVRKGSGRWYVHITFEVDRRYRSEIDLSDPAEPEAYDLGLCDIITDSKGERIGAPDLYARHENEIARLQRQIASMEDGPKRRKKQRRLSVLHERIRRRRDGYLDEVADRMVSGHSAVILEDLRLRRMIERDDSPAPRRKLFTEAALGTLVRKVEAKAERACIPLVKVDPAYTTRRCSCCGHVGEKMPLSLRVFSCPRCGLEMDRDHNAALNILGSGMGTLRGSAEPSG

SEQ ID NO: 2759 - protein, 423 aa, Unknown
  Description of Unknown: uncultivated organism sequence
  Category: MG90 effectors
  Description: MG90-82 effector
MAEEIKESVCSFCGKHYTDNDKTILFTADTPGALICYDCAKEIYSNYKDKIDSMREVSGSVQADQKWTPQSMKEYLDQYIIGQEKAKEILCTAVYNHYQILKMREDGNKDAVEVEKSNVIMAGPTGVGKTAIIKRLAKIMQVPCVIADSTSLTSAGYVGDDVESVIQSLLIEADYDVEKAQKGIVYLDEIDKTNRHGENPSTTADPGHEGTQQALLKLIEGTVANVPLKGQRKHPNADMVKVDTSNILFIVGGAFEGIEKIITRRHNSGMAGVGFGSVLVNDKDKKKSYNEIIGDLRVEDLKKFGMTPELLGRLPVICPMKELTEEQLVEILSKPKNSLLKQYQTLFKAQGVDLTFDDEALKTVAHLAIERKTGARGLRGIMENILSHEMYSIPSDDSIGSVTVTGKDFEIIRGEKPAEKVSA

SEQ ID NO: 2760 - protein, 432 aa, Unknown
  Description of Unknown: uncultivated organism sequence
  Category: MG90 effectors
  Description: MG90-83 effector
MAILDCVCSFCGNVIPDDISCVQGIGNTYICEPCARKVISSLNMTNTFLENEEKTKNMDAPEAFRLPHPAQIKAHLDKYIIGQEKAKEVLSVAVYNHYKMLAIKARRNAETNNTKKNMVELEKSNCLLIGPTGSGKTALIRVLAKILKVPLTIADATSYTSSGYVGKDCETILRDLLTAANGELERAERGIVYINEIDKTSRKGENMSITSDPGHEGLQQALLKLLEGSTVEVPISGRRLNPENGNSVMINTENILFIVGGAFEGIEKIIARRIRKESSAGTMGFGSQLIDKKNQKFNEFIERVTTEDLRKFGMLPEILGRLPVIAPLKELAEDELVNILYRPRNALVKQYQELLRHDGIDLEVTPLALHAIAREAIKKKTGARGLRGIMEDTLMDVMFKAPDRDENSIVIDADNHGKIIVNFIQKKVKEAV

SEQ ID NO: 2761 - protein, 354 aa, Unknown
  Description of Unknown: uncultivated organism sequence
  Category: MG90 effectors
  Description: MG90-84 effector
MDELLKPAEIKSFLDQYVIGQDAAKRYLSVAVYNHYKRLLYAPKEDEVELDKSNIVLVGPTGTGKTLMARTIARLLKVPFTIVDATVLTEAGYVGEDVESILSRLLQVADYDVEQAERGIVFIDEIDKIARKGDNPSITRDVSGEGVQQALLKILEGTVVNVPPQGGRKHPEQKFIQVNTRNILFICGGAFDGIEKRIAQRLNTRAMGYGRVNADPIDRGNLMQYVTPQDLKSFGLIPELVGRLPVLTYMQPLDRAALRSILTEPKNAIVKQYERLFEMDGVKLTFDDAVLDYIVDKAVEFKLGARGLRSICEAVMMDTMFELPSTDRKKFTVTLSYAKKKIEKANFLDLKKVG

SEQ ID NO: 2762 - protein, 382 aa, Unknown
  Description of Unknown: uncultivated organism sequence
  Category: MG90 effectors
  Description: MG90-85 effector
MAPGSSASRAHVQPAAADLDINIMTPAEIKEGLDQYVIGQDEAKRVLSVSVYNHYKRILSGKGGDVELQKSNVLLLGPSGVGKTLLAQTLAKMLGVPFAIADATTLTEAGYVGEDVENILLKLIQAADFDVQKAQIGIIYIDEIDKITRKSENPSITRDVGGEGVQQALLKILEGTVSNVPPQGGRKHPQQEFIQIDTTNILFICGGAFDGLDKYILRRTDKSALGFGSALKDNSTEAERALLRKVEPHDLVKFGLIPELIGRLPVITVLDDLDEDALVRVLKEPRNSLVKQYKELLGMDNVELTFTDEALHAIARKTIERKTGARGLRSVMESILLPIMYEVPSDATIIRVTVDEDTVEGGEAHLEYGAVRKRYKNQAALS

SEQ ID NO: 2763 - protein, 427 aa, Unknown
  Description of Unknown: uncultivated organism sequence
  Category: MG90 effectors
  Description: MG90-86 effector
MEKEGKIYCDFCGKEIEPGEFGATGINGVFICQDCLKEFHESVMAQDTYLESEKKKQEREEVEKEDFQIPRPSMIKAHLDKYIEGQDYAKRVLSVAVYNHYKMLRAKHSGEYNNKDVELEKSNILLCGPTGSGKTAVLRALSKYLKVPFTMADITSYSSAGYVGKDVETIIRDLIVAADGDVKAAERGIVYIDEIDKTSRKGENLSTTSDPGHEGVQQALLKLLEGQMVEVPNKGRRLHPESNNTTMVNTANILFIVGGAFEGIEKIVSQRLHQHSSSMGFGAKLEDKKNHQYNDFIEKVTTEDFRKFGMLPELLGRVPVIAPMKQLSEEQLVHILYRPKNALVKQYQELLSQDNVDLKFTQKALKSIAHDAIKRKTGARGLRGIMEDILNPVMFEVPDKDVDAVVVDADDDDKIKIEYKDLKKEAV

SEQ ID NO: 2764 - protein, 416 aa, Unknown
  Description of Unknown: uncultivated organism sequence
  Category: MG90 effectors
  Description: MG90-87 effector
MGRQTVRYRYRIYPTRGQEWAANRLFGCCRVLYNDVIDLFRSRFDPSNRTLMPTQSQAQSMLIAQAKKTPERAWLTEVSNVALIQMFRDAWQSCWNGVRKDRRQRFARYRSLKHNPVNSARFTRNGFTVRPNGVYLAKIGTVKTKWSRRLPSTPSSCTLIHEPNGRWYVSFVVERGTTPLPENGVFAGIDMGLSDMAAVVTTDGRRWKIGNPRNYTLLQKRIVRLQKHLAGQEKGSRRYARTRKRIAMLYAKAHDMLDDYQNKNVLHIVRETQTVGVETLDVHGIAVSHGRSARDAAIRSFLNKLEWKSEQYGRTVKHIGRWEPSTRLCSQCKHYVDGGIPEHVRVWQCADCGTILDRDWNAALNILDAAGLAESLNARGGSVRPDLASAGNGGTRGSANPSERRNVPSRRGIPVL

SEQ ID NO: 2765 - protein, 367 aa, Unknown
  Description of Unknown: uncultivated organism sequence
  Category: MG90 effectors
  Description: MG90-88 effector
MRELIYRAKRMDAMLDFDKTPSQLKKGLDEYVVGQEEAKKILSVAVYNHYKRLRAEMRNVGDEEYPDVEIEKSNVLLIGPTGSGKTYLARTLAKMLNVPFAIGDATTVTEAGYVGEDVENLVLNLVRAADYNIERAQCGIVYIDEIDKICRKNENVSITRDVGGEGVQQALLKILEGTVCNIPPKGGRKHPDQQYLRVDTRNILFICGGAFVGLDKIIARRTESKVLGFNSDIAEDSKSEAQILKKVQPEDLVKFGFIPEFIGRLPVVCSLAGLTESDLVHILTKTKNSLIKQYSKLLSLDGAKLRFTDGAVKAIARKAMDFGTGARALRSIMESVMLNIMYELPDQKKSGEVVIDESMINSASRAE

SEQ ID NO: 2766 - protein, 411 aa, Unknown
  Description of Unknown: uncultivated organism sequence
  Category: MG90 effectors
  Description: MG90-89 effector
MFETNIPERRCSFCGRGQNDVEALITGPKGVAICNVCVDECYKMLHEKEEKKKGAPVKIDKLPTPKEIKEFLDQYVIGQEEAKKVLSVAVYNHYKRIMSGGTVDDVELEKSNILLIGPTGSGKTLLARSLAKLLDVPFAIADATTLTEAGYVGEDVENILLRLIQAADYDIEKAERGIIYIDEIDKIARKSENPSITRDVSGEGVQQALLKILEGTIANVPPQGGRKHPHQQYIQIDTSNILFICGGAFVGLEDIIARRLGKGAMGFTADVDKKKMERDELLKHVEPDDLVKFGLIPELIGRLPVIATLKELTEDDLVRVLTEPKNALVKQYKKMLELEGVELEFTEDALREIAREAIRRKTGARGLRAIMEKLMTDVMFEVPTRKDVKKVIIDAEAVKTGKPKYELTKAS

SEQ ID NO: 2767 - protein, 403 aa, Unknown
  Description of Unknown: uncultivated organism sequence
  Category: MG90 effectors
  Description: MG90-90 effector
MKRCSFCGREQSKVEALISGPGGVAICNYCVDECYELIHGEKQKKGAPVKIDKLPTPKEIKEFLDQYVIGQEEAKKVLSVAVYNHYKRIMSGGSVDDVELEKSNILLIGPTGSGKTLLARSLAKLLDVPFAIADATTLTEAGYVGEDVENILLRLIQAADYDIEKAERGIIYIDEIDKIARKSENPSITRDVSGEGVQQALLKILEGTVANVPPQGGRKHPHQQYIQIDTSNILFICGGAFVGLEDIIARRIGKGAMGFTADVDKKKMERDELLKYVEPDDLVKFGLIPELIGRLPVIATLKELKEEDLVRVLTEPKNALVKQYKKLLEMEGVELVFTEEALREIAREAIRRKTGARGLRAIMEKLMTDVMFEVPTRKDIKKVIIDAEAVKTGKPKYELTKAS

SEQ ID NO: 2768 - protein, 411 aa, Unknown
  Description of Unknown: uncultivated organism sequence
  Category: MG90 effectors
  Description: MG90-91 effector
MFETGIPERRCSFCGKGQSEVEALITGPKGVAICNQCVDECYKLLHEKEEKKKGAPVKVDKLPTPKEIKEFLDQYVIGQEEAKKVLSVAVYNHYKRIMSGGTVDDVELEKSNILLIGPTGSGKTLLARSLAKLLDVPFAIADATTLTEAGYVGEDVENILLRLIQAADYDIEKAERGIIYIDEIDKIARKSENPSITRDVSGEGVQQALLKILEGTIANVPPQGGRKHPHQQYIQIDTSNILFICGGAFVGLEDIIARRIGKGAMGFTADVDKKKMERDELLKHVEPDDLVKFGLIPELIGRLPVIATLKELTEEDLVRVLTEPKNALVKQYKKMLELEGVELEFTEDALREIAREAIRRKTGARGLRAIMEKLMTDVMFEVPTRKDVKKVIIDAEAVKTGKPKYELTKAS

SEQ ID NO: 2769 - protein, 453 aa, Unknown
  Description of Unknown: uncultivated organism sequence
  Category: MG90 effectors
  Description: MG90-92 effector
MSEFVDEMLGKMMGGHEPSDSNGSTARCSFCGKKGGKDSLLVMSRSSKGIFICKDCIDSYHMKLQEEEKSSTGAKNFQKTIEGQKARIAPPVRIKKFIDDYVIGQETAKKTIAVSIYNHYKMVNMKHDLAESGNKDAGLDLSKSNLLIVGPSGSGKTHLLRVVARMLNIPFVIEDACSFTASGYVGRDVETMLRDLVDAAGGNIKAAERGIIYIDEIDKISRKGENPSTTSDPGNEAVQQGLLKLIEGNVVEVPVKGQRNHPQAETIKVNTENILFIVGGSFEGIEKIISKRVHKSAGRIGFFGETRNMHEQFNDLILEISTDDLRKFGMLPEFLGRLPVICPMQELTEDELVRILTEPKDAIVRQYRMLMGADGITLEFTDEALRKVAKEAIERKVGARGLRSIIEKILRPIMYSAPTDNDLESVVIDAGTDSEENYKVIRNYRNTADAMEA

SEQ ID NO: 2770 - protein, 474 aa, Unknown
  Description of Unknown: uncultivated organism sequence
  Category: MG90 effectors
  Description: MG90-93 effector
MKDYEEVKDTKDITEETEPKDDYEDVCYLCRRPESKAGKLIRLPMEGICICPDCMQRSFTMMGNTNINYEDLMKNMNLQDMFPGNIQDGIPKSQRLKKKKPKEKNEPVIDLKQILPPHQIKARLDDYVIGQDYAKKVMSVAVYNHYKRVATNTMDEIEIEKSNMLMIGPTGCGKTYLVRTLARLLDVPLAIADATSLTEAGYIGDDIESVVSKLLAAADNDVEKAERGIIFIDEIDKIAKKKNTTSRDVSGESVQQGLLKLLEGSDVEVPVGASSKNAMVPLTTVNTRNILFICGGAFPDLDGIIKARLNKTSGIGFGAMLSDAHDQDSDIVSQVTIDDLREFGMIPEFIGRLPVIFTLKGLDEAALVKILKEPKNAIIKQYQKLLALDEVDLQFDDGALEAIAKRAIEKKTGARALRSIIEELMLDIMYQIPKDDNIGRVTITQPYVEHRGGPLIEMRGIFSLPNKTPVAGIE

SEQ ID NO: 2771 - protein, 690 aa, Unknown
  Description of Unknown: uncultivated organism sequence
  Category: MG90 effectors
  Description: MG90-94 effector
MKHLLNYKYEIFPTKPQREQLNRTFRQTKIQWNKAVTIRKKLKSALMSGQFEHVIKTYLSAAADKSNTSSNRKKAILKVQQSLPQIDFETAAKLYDIKNLVGKVLGELTPRHADIAFLVNELKTSHSKELAERKAAIANGATGKSLPKLKTYWQMITAIGQLAGFKAKTFMDDSFESPSGMALSAIRFNVSGTKNAVRWNQAVQPKPGQRTYGATGEPRYKRRSDGFAYQIHDAAPADLIRSKKKNGHQIHLKALHKGNAWVDFAYHRPVPVDDKIKQFTVMTKAGRYFIALSTEVPTSAWAIAPMEAGWHAGIDPGAQTALTVGLVNSTSGEIKHLAIHYEFLEKSLTKLETLQQALSLKQGPRRKRTEVEIQEALTQYSKKRAVQKLTNAEKEKTLAKERERLERRMVFQGASRKWRQGAKSVSSLMLKIANQRQDVLHKISRALAEGCDVVGIGHWEPEREVSFRKKLRLLKKQVKAGVAGATATLKEHIEEKSKEGPKGIKKRRRGGRDRSIATLRMLINEKAVRSGVKAFTDINESYSTMTCSSCGEATGPTGIVNLGIREWQCGNCNVSHHRDLNSAFNILKKTELELAAAQAAAPATGSTATRTDAQGAQSAPGSDAGSGYLATGHHGRGGSFFYEHAEVSLPDLWKEEVPRALKSLIQMGVVRALTLQRADEKSSKSPPAQT

SEQ ID NO: 2772 - protein, 426 aa, Unknown
  Description of Unknown: uncultivated organism sequence
  Category: MG90 effectors
  Description: MG90-95 effector
MNDIVDIDENQHYCCFCGKAISDEATVVQGDDNVLICFDCIKEIYEENIERVEQRKKNALINKLNKDVTPSSIKRYLDEYIIGQESAKKVLSVAVYNHYKSLRIKSKDNAVDLEKSNIILLGPSGCGKTAILKALSKFLNVPFAMADASTLTAAGYVGADVETVLQKLILEANGDIKKAQKGIVYIDEIDKIARKGENLSTTADPGHEGVQQALLKMIEGSVVSVPPKGQRNHPQADMIRIDTSNILFIVGGAFENIDKIVEKRIKSSKGSMGFNGVLKDTSKTYNDFIKEVRTEDLKKFGMLPELLGRLPIICPMEELDKKALIRILTEPKNALVKQYQAILQADNVKLSFTEKALEYIADKAIKRKTGARSLRSILEEELNQTMYELPDKKDITAVLVAVENNNICIEYIKEIEGVKIYDNICK

SEQ ID NO: 2773 - protein, 479 aa, Unknown
  Description of Unknown: uncultivated organism sequence
  Category: MG90 effectors
  Description: MG90-96 effector
MSDYKDKDELTKTEDTSSDHKKDDSHKEYEDICYVCRRPESKAGKMIHLPINNICVCADCMQKSFDTMNNSGMSDMMNMNNINFQDLMNFGMPMMGGPDMMPKSQKLKKKKPKEEAQPVFDIKKIPAPHVIKAQLDDYVIGQEYAKKVMSVAVYNHYKRVATNTMDDIEIEKSNMLMIGPTGCGKTYLVRTLAKLLDVPLAITDATTLTEAGYIGDDVESVVSKLLAAADNDVEKAERGIIFIDEIDKIAKKKNTTSRDVSGESVQQGLLKLLEGSDIEVPVGASSKNAMVPMTTVSTRNILFICGGAFPDLENIIKERLTQQSSIGFIADLKDKYDNDKNLISKVTIDDLRTFGMIPEFIGRLPVIFTLQGLSEDMLVKILKEPKNAILKQYQKLLALDEVDLQFSDDALTAIAAKAMEKKTGARALRSIIEEFMLDIMYEIPKDDNIGRVTITREYIENTGGPVIEMRGALPVTKNS

SEQ ID NO: 2774 - protein, 351 aa, Unknown
  Description of Unknown: uncultivated organism sequence
  Category: MG90 effectors
  Description: MG90-97 effector
MPKPKDIKEYLDQYIIGQDDAKRYMSVAVYNHYKRLAQANTDKKDQDDVEIEKSNIVMVGSTGTGKTLLARTIARLLDVPFTIVDATVFTEAGYVGEDVESILSRLLQVADYDVAKAERGIVFIDEIDKIARKADNPSITRDVSGEGVQQGLLKLLEGTMVNVPPKGGRKHPDQDYIHVDTRNILFICGGAFDGIEKRIAQRLNAHTVGYNSVQNAKKIDPKNLMKYVEPQDLKSFGLIPEIIGRLPVLTYLNPLDKEALTRILVEPKNSIVKQYIKLFAMDGVKLTFKQDALDYIVDKAVEFKLGARGLRSIVETIMMDAMFEIPSSGEKQFEVTKEYAENQMEKRGNLA

SEQ ID NO: 2775 - protein, 411 aa, Unknown
  Description of Unknown: uncultivated organism sequence
  Category: MG90 effectors
  Description: MG90-98 effector
MFETKIPMRRCSFCGRDQSKVEALITGPGGVAICNYCIDECYEMIHQEEERKGAPSISIDKLPTPKEIKEFLDQYVIGQDEAKKVLSVAVYNHYKRIMSGKDTDDVEIEKSNILLIGPTGSGKTLLARSLAKLLDVPFAIADATTLTEAGYVGEDVENILLRLIQAADYDIEKAERGIIYIDEIDKISRKSENPSITRDVSGEGVQQALLKILEGTIANVPPQGGRKHPHQQYIQIDTTNILFICGGAFVGLEDIIARRIGKGAMGFTADVDKKKLNRDELLKHVEPDDLVKFGLIPELIGRLPVVATLSELKEEDLVRVLKEPKNALVKQYKKLLELEGVELEFTDDALRAIAKEAIRRKTGARGLRAIMEKIMTDVMFEVPTRKDIKKVIIDADSVKTGKPKYELVKAS

SEQ ID NO: 2776 - protein, 424 aa, Unknown
  Description of Unknown: uncultivated organism sequence
  Category: MG90 effectors
  Description: MG90-99 effector
MENKIVCEMCGREIPAQTTVVQSIKGQVFCADCISKCYKALKNMEPHIEKAEKTRDLDTKAVKLAKPTELKKYLDGFIEGQEKAKQVLSVAIYNHYKKLVMRASGKATKGIELEKSNVLLIGPSGCGKTAILRSLAKALKVPFVMADATAYSSSGYVGRDVEMIIRDLLNAAGGDVEAAERGIVYIDEIDKIGRKGENVSTTADPGHEGVQQAILKLLEGSVLEIPDKGQRVHPDAKMTRVNTENILFIVGGAFEGIEKIIAARLRKQLDAGTMGFGSQLVDTKNQRFNEFIEQVTTDDLKKFGMLPEVLGRVPIIAPMKELSEEQLVHILYHPKNALIRQYKELLSYDNVVLDVTEEAMRAIAKEAIARKTGARGLRGIMEEILGPVMFSAPDRGEDITLDVDKDGKIAVIYQKHEDVKREAV

SEQ ID NO: 2777 - protein, 403 aa, Unknown
  Description of Unknown: uncultivated organism sequence
  Category: MG90 effectors
  Description: MG90-100 effector
MSILEDESSLANRKTGYERETQAKILPKPQEIKKQLDNYVIGQEQAKIALSVAVYNHYKRIYFGKSDDVELSKSNVLLLGPTGVGKTMLAQTLARILDVPFAIADATTLTEAGYVGEDVENILLRLIQAADFNIELAERGIIYIDEIDKIARKSENPSITRDVSGEGVQQALLKILEGTVSNVPPQGGRKHPHQEFIQVNTKNILFICGGAFDGLEKIIERRLDQKSIGFGANVQGKKDKDISKILHEVQPHDLLKFGIIPELVGRLPVIASLNALKREDLVRILTEPKNALVKQYKKLMEYDEVELEFQPEALEAIADKAIERNIGARGLRAVMEGILTPMMYDIPSDPTVVKAVITKDCVEGRSGPELTHDPKKINYSVKLNTGKGEGRPASGSSTPASAS

SEQ ID NO: 2778 - protein, 423 aa, Unknown
  Description of Unknown: uncultivated organism sequence
  Category: MG90 effectors
  Description: MG90-101 effector
MAEEIKESVCSFCGKHYTDNDKTILFSADTPGALICYDCAKEIYSNYKDKIDSMREVSGSVQADQKWTPQSMKEYLDQYIIGQEKAKEILCTAVYNHYQILKMREDGNKNAVEVEKSNVIMAGPTGVGKTAIIKRLAKIMQVPCVIADSTSLTSAGYVGDDVESVIQSLLIEADYDVEKTQKGIVYLDEIDKTNRHGENPSTTADPGHEGTQQALLKLIEGTVANVPLKGQRKHPNADMVKVDTSNILFIVGGAFEGIEKIITRRHNSGMAGVGFGSVLVNDKDKKKSYNEIIGDLRVEDLKKFGMTPELLGRLPVICPMKELTEEQLVEILSKPKNSLLKQYQTLFKAQGVDLTFDDEALKTVAHLAIERKTGARGLRGIMESILSHEMYSIPSDDSIGSVTVTGTDFEIVRGEKPAEEISA

SEQ ID NO: 2779 - protein, 354 aa, Unknown
  Description of Unknown: uncultivated organism sequence
  Category: MG90 effectors
  Description: MG90-102 effector
MEELLKPAQIKDFLDQYVIGQDDAKRYMAVAVYNHYKRLLYAPKEDEVEIDKSNIVLVGPTGTGKTLMARTIAKLLNVPFTIVDATVLTEAGYVGEDVESILSRLLQVADYNVEQAERGIVFIDEIDKIARKGDNPSITRDVSGEGVQQALLKILEGTTVNVPPQGGRKHPDQKFIQVDTRNILFICGGAFDGIERKIAQRLNTRAMGYGRAGADPIDRSNLMQYVMPQDLKSFGLIPELVGRLPVLTYMQPLGREALRSILTEPKNAIVKQYVRLFEMDGVKLAFDDEVLDYIVDRAIVYKLGARGLRSICEAVMMDTMFDIPSSGCKEFRVTLPYAKEKIEKANFVELKKVG

SEQ ID NO: 2780 - protein, 439 aa, Unknown
  Description of Unknown: uncultivated organism sequence
  Category: MG90 effectors
  Description: MG90-103 effector
MIDWGLQQHVTSKLTVPKPKDIKAKLDEYIVKQDYAKKVLAVAVHNHYKRIMSPAKDGIELGKSNILLIGPTGTGKTLLAQTLAKILDVPFAMADATSLTEAGYVGDDVENVVLNLVNAADGDIERACRGIIYIDEIDKIAKKGENPSITRDVSGEGVQQSLLKMIEGTVAAVPPKGGRKHPQQEFLRVDTTNILFICGGAFVGLADIIDKRTSLGSMGFNANVVNKDKRDLSALYHALEPEDLLKFGLIPELVGRLPVVATLEPLDEAALTEILTEPKNSLVKQYKKMFKIDGVDLEFDDDALAEIAKLAIKKESGARGLRSILENAMMPFLYAVPGMPNMKKLVVTSDIIAKQGDLSQIDELNARYNAKQDDKSSNASTKTSDAKSDADQSDDAKSGSEQSDDKSISSDDTIDDKSINADDKKAKSARAKKTKKTDP

SEQ ID NO: 2781 - protein, 408 aa, Unknown
  Description of Unknown: uncultivated organism sequence
  Category: MG90 effectors
  Description: MG90-104 effector
MTAGNNNQTVRYNYRLYPTKTQETVLNRLFGCCRVVYNDTIDFFNNNFNPNNQSKLPTASKASKQILTNAKKTTKRAFLKEVSSVALQQEFRNAWLACWHGVSHTSNQKPAKRKTKKHNPVNSANFTSNGFSVNQHGVYISKIGVIKTKWSRPMPSEPTSCTISHARNGRWYASFVVKRPKTPFKQCDNNAGIDMGLTDMATIVNTRGERWKIANPRNYAKIQDKIGRLQRHLSKQTKGSKRYERTRHQIALLYSKAHDALADYQWKNVLNIIRETQAIGVETLDIQSMKAKHGKSVRDAAMRSFLNKLGSKAEEHDRSIIQLNQWLATTKLCALCKYKLKAGIPEYARHWVCPKCGAHLDRDYNAALNILDAAGLAESLNARGGGVRSFLASAENGCSRRTAYHPSF

SEQ ID NO: 2782 - protein, 438 aa, Unknown
  Description of Unknown: uncultivated organism sequence
  Category: MG90 effectors
  Description: MG90-106 effector
MPKDEFTTRRLHRCSFCYKTQDQVRRLVAGPDGYSGDEGIKLCYDIIADDVTPMSTAAPDSPSLPLPSEMKAVLDEYVIGQDEAKRTLCVAVYNHYKRINAPQKAGDVELQKSNILMVGPTGCGKTYLAQSLARILNVPFAIADATALTEAGYVGEDVENILLRLIQAADGDIRAAQRGIIYIDEIDKISRKGENVSITRDVSGEGVQQALLKILEGTVANVPPQGGRKHPQQEFMQIDTTNILFICGGAFDGLAPIIQQRIGSRTLGFGAKLTGDSAADVGNVLRQLRPEDLMKFGLIPEFVGRLPVVVTLDQLDESALVRILTEPRNALVKQYAKLLELDGVSLSFDQDALTAIAHMAMQQKSGARGLRAIIEKALLDTMFDLPGQNDVTACHVTGDVITAGAKPQLTRAAHSARTLRSKKPAALPEEKKEAPDAV

SEQ ID NO: 2783 - protein, 394 aa, Unknown
  Description of Unknown: uncultivated organism sequence
  Category: MG90 effectors
  Description: MG90-107 effector
MEEGSAEKGHVTVVYPAYPNGAQERELLRTLDVVRGLYNHFLAECIADVVEGDRFPTPMEMNKGITEMRSRDEELRSVAVFILRDAPLRVHAAMTRFAKLSAMSGELRLPRFKSESRYRSLAFDPKSVSFDGRRIVLGRWMGLRCGNIDRSHRLHRPEGGRVVTARIVRRGSDRWYVHVTFEVDKRYRSGIDLSDPAQPEAYDLGLCDIITDTKGEKVVAPDLYARHEREIARLQRQIESMEDGPKRRKKQRRLAVLHERIRRRRDGYLDEVANQMVSGHSAVILEDLRLRRMMERDDNPAPRRKLFTEAALGILVRKVEAKAERACIPLVKVDPAYTTRTCSCCGHVGGRMPLTQRVFSCPRCGLEMDRDHNAALNILGSGMGTLRGSAEPSG

SEQ ID NO: 2784 - protein, 392 aa, Unknown
  Description of Unknown: uncultivated organism sequence
  Category: MG90 effectors
  Description: MG90-108 effector
MSRRAGGSEDKWFVTRVYPAYPNRTQERELLRQLDVARGVYNHFADTCIHCLIDGVHIPDPMEMNREFTLMRADDCLLRSVNSYTLREGINRVWQAVERCERRSLADGELHVPRIKTPPRFRSICFDPKSSKIENSRIRLNRDLSVRCRNLVRPRNGRAVTVRAVRRGTGRWYICITYETDRVVRGEMDVGEPDRAEGYDLGLVDLITDSSGNKIRTPDFFREAEAELAHLRRQLSRLEEGTAKWLKTRRRIARIEERIRSRRDGCLDRVADWMVSGKPTVVVEDIDVRRLASREDGTLVRRKRFTEAAWATLVGKAERKARKTDVRLIRVSPAYTTRTCSRCGHVGDGIPLSERMFRCPACGLEMDRDRNAARNILGSGMGTQRCTAEPSG

SEQ ID NO: 2785 - protein, 391 aa, Unknown
  Description of Unknown: uncultivated organism sequence
  Category: MG90 effectors
  Description: MG90-109 effector
MEEGSADKGHVTIVYPAYPNVGQLLRTLGVVRGLYNHFLAESIADVMEGDRFPTPREMNKAITVMRGRDIGLGSVAVFTLRDAPLRVHAAMTSFAKLSARSGELRLPRFKSESRYRSLAFDPKGVKFDGRRIVFGKWMKLRCGNLDRNRKLHRPEGGRIVTARIVRKGSGRWYVHITFEVDRRYRSEIDLSDPAEPEAYDLGLCDIITDSKGERIGAPDLYARHENEIARLQRQIASMEDGPKRRKKPRRLSVLHERIRRRRDGYLDEVADRMVSGHSAVILEDLRLRRMIERDDSPAPRRKLFTEAALGTLVRKVEAKAERACIPLVKVDPAYTTRRCSCCGHVGEKMPLSLRVFSCPRCGLEMDRDHNAALNILGSGMGTLRGSAEPSG

SEQ ID NO: 2786 - protein, 411 aa, Unknown
  Description of Unknown: uncultivated organism sequence
  Category: MG90 effectors
  Description: MG90-110 effector
MFETQVPMRKCSFCGRPQNEVEALITGAGGVAICNFCIDECYKMLHEGEEKKKGAPISIDKLPTPKEIKEFLDQYVIGQEEAKKVLSVAVYNHYKRIMAGGSVDDVELEKSNILLIGPTGSGKTLLARSLAKLLDVPFAIADATTLTEAGYVGEDVENILLRLIQAADYDIEKAQRGIIYIDEIDKIARKSENPSITRDVSGEGVQQALLKILEGTIANVPPQGGRKHPHQQYIQIDTSNILFICGGAFVGLEDIIARRIGKGSMGFTADVDKKKMERDELLKHVEPDDLVKFGLIPELIGRLPVIATLKELKEEDLVRVLTEPKNALVKQYKKLLELEGVELEFTEEALREIAREAIRRKTGARGLRAIMEKLMTNVMFEVPTRKDIKKVIIDAEAVKTGKPKYELTKAS

SEQ ID NO: 2787 - protein, 385 aa, Unknown
  Description of Unknown: uncultivated organism sequence
  Category: MG90 effectors
  Description: MG90-111 effector
MLLSGIEGYICKDCSDQAVKIFKEQHQHRPGKGYDPNTPIPTPTEIKEFLDLYVIGQDAAKRVLSVAVYNHYKRLKYNALNGDKNDVEIEKSNIILVGETGTGKTLLARTIARLLKVPFCIADATTLTEAGYVGDDVENVLVRLLQAADYDVAAAERGIVFIDEIDKIARKSENTSITRDVSGEGVQQALLKLLEGAEVSVPPEGGRKHPEQKLINVNTRNILFICGGAFDGVERSIAARLNSNVIGFKGDEKRQELDRENMLQYVQPMDLKKFGLIPELVGRFPVLTHLEALDRDALRRILTEPKNALTKQYEALFSMDGVELKFDPAVLDMIVDRAVEYHLGARGLRGIMEGIMTDLMFDLPQMPKGGTYTLTPEVAKAKMKL

SEQ ID NO: 2788 - protein, 340 aa, Unknown
  Description of Unknown: uncultivated organism sequence
  Category: MG90 effectors
  Description: MG90-112 effector
MVGQDRAKRSIAVAVYNHYKRILGKGDPNVDIEKSNILMIGPTGSGKTYIARSLAKILGVPFAIADATTLTEAGYVGEDVENVLLKLINAADNDIKRAEKGIVYIDEIDKIARKGENTSITRDVSGEGVQHALLKILEGTVASVPPQGGRKHPQQEMLKIDTSNILFICGGAFAGIEKILAKETKKNAIGFGAAFEEKKEMTLSEQLRGLTPQDLMKFGLTPEFVGRLPVFVALDELDEEAMVRILTEPRNSLVKQYQKLLEIDGVELEFEPEALREIAQTAMRKNTGARGLRAIMENVMEDIMFDMPDEENVKKCIVTKAAVLGEEKPVLVRGKQDRSA

SEQ ID NO: 2789 - protein, 426 aa, Unknown
  Description of Unknown: uncultivated organism sequence
  Category: MG90 effectors
  Description: MG90-113 effector
MNDIVDIDENQHYCCFCGKAISDEATVVQGDDNVLICFDCIKEIYEENIERVEQHKKNALINKLNKDVTPSSIKRYLDEYIIGQESAKKVLSVAVYNHYKSLRIKSKDNAVDLEKSNIILLGPSGCGKTAILKALSKFLNVPFAMADASTLTAAGYVGADVETVLQKLILEANGDIKKAQKGIVYIDEIDKIARKGENLSTTADPGHEGVQQALLKMIEGSVVSVPPKGQRNHPQADMIRIDTSNILFIVGGAFENIDKIVEKRIKSSKGSMGFNGVLKDTSKTYNDFIKEVRTEDLKKFGMLPELLGRLPIICPMEELDKKALIRILTEPKNALVKQYQAILQADNVKLSFTEKALEYIADKAIKRKTGARSLRSILEEELNQTMYELPDKKDITAVLVAVENNNICIEYIKEIEGVKIYDNICK

SEQ ID NO: 2790 - protein, 391 aa, Unknown
  Description of Unknown: uncultivated organism sequence
  Category: MG90 effectors
  Description: MG90-114 effector
MIYGPGIAKAQKKAAKKDGDKSLSSMKLLKPREIKEFLDDYVIGQDDAKISLAVAVYNHYKRIMSQEAAEKNLNDDDGVDLQKSNVLLLGPTGVGKTFLAQTLAKLLNVPFAIADATTITEAGYVGDDVENVLLRLIQAADFDIKAAERGIIYIDEIDKIARKSENTSLTRDVSGEGVQQALLKIIEGTVSNVPPQGGRKHPNQEVIQINTKNILFICGGAFDGLERQIQKRIGKAPIGFGGDIKAHHEIKDNIFKKVIPKDLVKFGMVPEFVGRLPVITVLDELDEDSLVKILTEPKNALIKQYKKLFDYDDIELEIEDGALVEIAKKAIAQKTGARGLRSILEGILMNTMFTVPSDGSIAKVTVTADCVLNGTQPILMNRRNKVVTIAV

SEQ ID NO: 2791 - protein, 435 aa, Unknown
  Description of Unknown: uncultivated organism sequence
  Category: MG90 effectors
  Description: MG90-115 effector
MAKYDDPKDRTIRCSFCGRTQDQVGMLIQGPDAFICDSCIASCLEIIESGESDSIGKPAGKKKPTASPRILPKPNELKARLDEYVIGQDEAKIALSVAVYNHYKRIYRKPKTDVEITKSNVLLLGPTGVGKTFLAQNLAKTLDVPFAIADATTLTEAGYVGEDVENILLRLIQAADFDVEKAERGIIYIDEIDKIARKSENTSITRDVSGEGVQQALLKILEGTVANVPPQGGRKHPQQEFIQIDTSNILFICGGAFDGIERIGEKRLGNSVLGFGSELIVKSELDHDTIMQKVIPQDLIKFGLIPELVGRMPVLTALRNLDEDALVRILKEPKNALFKQYKALFEIDKVELEFTDDAFRAIARSALEKNTGARGLRAIMEKVLQPVMYEIPSDPSVTRVTVTAACVNGEGNPAIERDPTRLAPPKENNLKPTIA

SEQ ID NO: 2792 - protein, 427 aa, Unknown
  Description of Unknown: uncultivated organism sequence
  Category: MG90 effectors
  Description: MG90-116 effector
MDNHKKNVICSFCGKKVSEDNFVAQGIEENIFICQDCINEIHKTVADADSFIETIEESRKKEEKKMSKLPRPSEIKAHLDQYIIGQDYAKRVLSVAVYNHYKMLDVKLNKKAINKDVELEKSNVLLAGPSGSGKTAILKALAKLLKVPFVIADATEYSEAGYVGKDVECIARDLISAANGDIRKAERGIVYIDEIDKTGRKGENLSATADPGHEGTQQALLKLLEGSVIDVPMDGRRLNPESRNLQKIDTTNMLFIVGGAFEGIDKIIAKRKRQGKNTIGIGANLTDRKNDQFNDFIEDLTTEDLKKFGMLPEILGRVPVIAPLKELTEDQLVHILYQPKNALVKQYQELLAQDGVELEVTDAALTAIAKKAIKRKTGARGLRGIMEDILNPVMFSIPDKDEDYVLIDAVDGKLEISYQKKIKREAV

SEQ ID NO: 2793 - protein, 346 aa, Unknown
  Description of Unknown: uncultivated organism sequence
  Category: MG90 effectors
  Description: MG90-117 effector
MIGQDEAKRVLAVSVYNHYKRILSGKGSDVELQKSNVLLLGPSGVGKTLLAQTLAKMLGVPFAIADATTLTEAGYVGEDVENILLKLIQAADFDVQKAQIGIIYIDEIDKITRKSENPSITRDVGGEGVQQALLKILEGTVSNVPPQGGRKHPQQEFIQIDTTNILFICGGAFDGLDKYILRRTDKSALGFGSSLKDNSSEAEKALLRKVEPHDLVKFGLIPELIGRLPVITVLDDLDEDALVRVLKEPRNSLVKQYKELLSMDNVELNFTDEALHAIARKTIERKTGARGLRSVMESILLPIMYEVPTDATIIRVTVDEDTVEGGEAHLEYGAVRKRYKNQAALS

SEQ ID NO: 2794 - protein, 403 aa, Unknown
  Description of Unknown: uncultivated organism sequence
  Category: MG90 effectors
  Description: MG90-118 effector
MRKCSFCGRPQNEVEALITGAGGVAICNFCIDECYKMLHEEEQKKGAPVSIDKLPTPKEIKEFLDQYVIGQEEAKKVLSVAVYNHYKRIMAGGSVDDVELEKSNILLIGPTGSGKTLLARSLAKLLDVPFAIADATTLTEAGYVGEDVENILLRLIQAADYDIEKAQRGIIYIDEIDKIARKSENPSITRDVSGEGVQQALLKILEGTIANVPPQGGRKHPHQQYIQIDTSNILFICGGAFVGLEDIIARRIGKGSMGFTADVDKKKMERDELLKHVEPDDLVKFGLIPELIGRLPVIATLKELKEEDLVRVLTEPKNALVKQYKKLLELEGVELEFTEEALREIAREAIRRKTGARGLRAIMEKLMTNVMFEVPTRKDIKKVIIDAEAVKSGKPKYELTKAS

SEQ ID NO: 2795 - protein, 393 aa, Unknown
  Description of Unknown: uncultivated organism sequence
  Category: MG90 effectors
  Description: MG90-119 effector
MEQEDKASGKKSKGKQKEDKHELIKPAELKEILDKYIIGQDEAKKTICVSVYNHYKKNFFGDEATADEIELQKSNVLLLGPTGVGKTMIAQTLANVLKVPFAIADATTLTQAGYVGEDVENVLLRLIQAADYDIEAAEHGIIYIDEIDKITRKSENTSITRDVSGEGVQQALLKIIEGTVSNVPPQGGRKHPNQEFIQINTKNILFICGGAFEGIDKLVMQRTSSSALGFGAEVKSKQDNKINEARHQGEPEDLDKFGIIPELVGRLPVIAVLDDLDEDALVKILSEPKNAILKQYSYMFSLDGIELEITDDAMRAIAKKAAERKTGARGLRTVVEEALSDIMFDAPSDDTISKVILTGECVTDGKAPEVIRDPSARKNRRNSEKKTAKKNPA

SEQ ID NO: 2796 - protein, 354 aa, Unknown
  Description of Unknown: uncultivated organism sequence
  Category: MG90 effectors
  Description: MG90-120 effector
MDQYVIGQDAAKKVLSVAVYNHYKRVLAGKDLDVELQKSNILLLGPTGSGKTYLAQTLAKILNVPFAIADATTLTEAGYVGEDVENILLKLIQAADYDIERAQHGIIYIDEIDKITKKSENVSITRDVSGEGVQQALLKILEGTEASVPPQGGRKHPQQELIPIDTTNILFICGGAFDGLGKIIERRLDKGSIGFNSQIIEKTDKSEDELFKQVMPEDLTKFGLIPEFIGRVPVTVSLDFLDEKALERILTEPKNALIKQYKKLFELDGVELKFTDEAINTIAKKAVERKTGARGLRAILENAVMDIMYETPSDETIKECIVNEDVINGLADPELVYNSVIGKKKAKKNKDKTA

SEQ ID NO: 2797 - protein, 367 aa, Unknown
  Description of Unknown: uncultivated organism sequence
  Category: MG90 effectors
  Description: MG90-121 effector
MKIRFEEFKDEISTDILDSKTPKELLAILNDYVIGQDNAKRALSVAVYNHYKRINFMASKADEEVELQKSNILMIGPTGSGKTFLAQTLAKSLNVPFAIADATSLTEAGYVGEDVENILLKLLQAADYNVDRAERGIIYVDEIDKIAKKSENVSITRDVSGEGVQQALLKIIEGTVASVPPQGGRKHPNQEMIQLDTKNILFIVGGAFDGIEEIVKQRLGEKIIGFGFNNKALSEDMSYMQEIIAEDIQKFGLIPEFIGRLPIVAALESLTESDLVHILTQPKNALVKQYQRLLSFDNVELEFEDAALKAIAEKAIQRKTGARGLRSIIEEVMMDVMFEIPSMTGIRKVVITEDAVLGTNEPLLIGA

SEQ ID NO: 2798 - protein, 393 aa, Unknown
  Description of Unknown: uncultivated organism sequence
  Category: MG90 effectors
  Description: MG90-122 effector
MEQEDKASGKKSKGKQKEDKHELIKPAELKEILDKYIIGQDEAKKTICVSVYNHYKKNFFGDEATADEIELQKSNVLLLGPTGVGKTMIAQTLANVLKVPFAIADATTLTQAGYVGEDVENVLLRLIQAADYDIEAAEHGIIYIDEIDKITRKSENTSITRDVSGEGVQQALLKIIEGTVSNVPPQGGRKHPNQEFIQINTKNILFICGGAFEGIDKLIMQRTSSSALGFGAEVKSKQDNKINEALHQVEPEDLVKFGIIPELVGRLPVIAVLDDLDEDALVKILSEPKNAILKQYSYMFSLDGIELEITDDAMRAIAKKAAERKTGARGLRTVVEEALSDIMFDAPSDDTISKVILTGECVTDGKAPEVIRDPSARKNRRNSEKKTAKKNPA

SEQ ID NO: 2799 - protein, 496 aa, Unknown
  Description of Unknown: uncultivated organism sequence
  Category: MG90 effectors
  Description: MG90-123 effector
MQTKNPDSQTMDPKKARCVFCGKTADEVAGMIQSPDGTCICDECILYCTDVLARGGYLNGRHPSQGNMPDSFDGDFDGYEGHIAQAPFDDEEQGAPSAAEILAALPTPHELFDRLSQHVVGQEAAKRALSVAVYNHYKRISLGAESNDDDVELAKSNIMLLGPTGSGKTLLAQTLARTLQVPFAIADATTLTEAGYVGEDVENILLKLITAADFDIERAQIGIIYIDEIDKIARKAENLSITRDVSGEGVQQALLKIVEGTEASVPPQGGRKHPQQELIHIDTTNILFILGGAFVGLADIIGQRVGKKGIGFTSDVPQSKKHAEAELLEKVLPEDLNKFGMIPEFVGRIPVICSLDELTEDDLVHILTDPKNALVKQYVRMFEFENSELVFTPEALRAIAHEAVEHGTGARGLRAICERVLQDVMFDLPEHAGRGWLFARAISRAKRNPKSSRRPTRLSSPNKCHGLAACATGLFQYSALQANKLGAESGRAFQEL

SEQ ID NO: 2800 - protein, 338 aa, Unknown
  Description of Unknown: uncultivated organism sequence
  Category: MG90 effectors
  Description: MG90-125 effector
MIGQDDAKRYMSVAVYNHYKRLLHASGEASEVELDKSNILLVGPTGTGKTLMARTIAKLLNVPFTIVDATVLTEAGYVGEDVESILSRLLQVASYDVELAQRGIVFIDEIDKIARKSDNPSLTRDVSGEGVQQALLKILEGTVVNVPPQGGRKHPEQQFVQVDTRNILFICGGAFDGIEKKIAQRLNTRAMGYGRMNADSVDRNNLMQYLMPQDLRSFGLIPELVGRLPVLTYMEPLGREALRSILTQPKNAIIKQYEKLFEMDGVKLVFDDEVLDYIVDKAIEYRLGARGLRSICEAIMMDTMFDIPSSGERRFEVTLPYAREKFEKKKFLALKQVG

SEQ ID NO: 2801 - protein, 337 aa, Unknown
  Description of Unknown: uncultivated organism sequence
  Category: MG90 effectors
  Description: MG90-127 effector
MLAVSVYNHYKRILSGKGADVELQKSNVLLLGPSGVGKTLLAQTLAKMLGVPFAIADATTLTEAGYVGEDVENILLKLLQAADFDVQKAQVGIIYIDEIDKITRKSENPSITRDVGGEGVQQALLKILEGTVSNVPPNGGRKHPQQEFIRIDTTNILFICGGAFDGLDKYILRRTDRSALGFGSSLKDNSEDAQRALLRKVEPHDLVKFGLIPELIGRLPVITVLDDLDEDALVRVLKEPRNSLVKQYKELLSMDSVELEFTDEALHAIARKTIERKTGARGLRSVMEGILLPVMYDVPNDPTIIRVTIDKDTVEGGEAHLEYGAVRKRYKNQTALS

SEQ ID NO: 2802 - protein, 398 aa, Unknown
  Description of Unknown: uncultivated organism sequence
  Category: MG90 effectors
  Description: MG90-128 effector
MDIIADEDSLHRGRPQPKNKPRAEMVLPKPQEIKKQLDEYVIGQDEAKMTLAVAVYNHYKRIFFSGEDGGVEIAKSNVLLLGPTGVGKTYLAQTLAKLLDVPFAIADATTLTEAGYVGEDVENILLRLIQAADYDIERAEHGIIYVDEIDKISRKSENPSITRDVSGEGVQQALLKILEGTIAGVPPKGGRKHPQQEVINIDTSNILFICGGAFDGLKSVIQRRTETQTLGFNSVIKSKDELDNTEWMKEVTPHDLVKFGLIPELVGRLPVITALSDLDKAALVRILTEPKNCLVSQYKKLFDLDKVDLEFTPEALDAIAEKTIARKTGARGLRSIMEDTLKNLMFEVPSDYTIEKITVTKDSVENGAAPEIVHNPDRVPVKIKMTQPKRLARKDSAS

SEQ ID NO: 2803 - protein, 537 aa, Unknown
  Description of Unknown: uncultivated organism sequence
  Category: MG90 effectors
  Description: MG90-129 effector
MPNLLNYKYEIFPTKPQKAQLYRILRESKYQWNKAVTIRKKLKSALVSGQIEFVINTCLSAEKNNQQGQRANAIEKLRSQFPEMEFETAAHCYDVKNIIGKVLGDLPIEKLLDLKSLSEELKTRHEKEVANRKDAIAKGIDNKKLPKLTVLWQLIGAINRYAGYAAKKYMDKSFESSKGMSVSPVRSNISGSANSPRWNNAVQPSKDQRSYGATGEPNYKKRCDGFSYQIPQKKAEAVSEFFRLKRQNHGYQIFLNPLHEGNRWIDTAYHRPIPEGSKIKQMTINERAGHFFAVLSVEVPDRAWMIASMQAGWWAGIDPGASTALTIAFHNAETSETRQAAINYQFLEKSLAQLEKLQQCIAKKQGPRRKRTEDEVNKELAQFSKKQSIQKLPEQERSKIIAKKKENLEKKMIRQDASNSWKKFSRKVGEFNYRIANKRLDVLHKISRSLIEGCDVVGIGHWEPERQVSYRKERKALKKQVKAGVAGAKERLNALEEEKSKQGPKGVKKARRGGRDRAIATLRGLVDEKAKRAGTVE

SEQ ID NO: 2804 - protein, 423 aa, Unknown
  Description of Unknown: uncultivated organism sequence
  Category: MG90 effectors
  Description: MG90-130 effector
MAEEIKESVCSFCGKHYTDNDKTILFTADTPGALICYDCAKEIYSNYKDKIDSMREVSGSVQADQKWTPQSMKEYLDQYIIGQEKAKEILCTAVYNHYQILKMREDGNKNAVEVEKSNVIMAGPTGVGKTAIIKRLAKIMQVPCVIADSTSLTSAGYVGDDVESVIQSLLIEADYDVEKAQKGIVYLDEIDKTNRHGENPSTTADPGHEGTQQALLKLIEGTVANVPLKGQRKHPNADMVKVDTSNILFIVGGAFEGIEKIITRRHNSGMAGVGFGSVLVNDKDKKKSYNEIISDLRVEDLKKFGMTPELLGRLPVICPMKELTEEQLVEILSKPKNSLLKQYQTLFKAQGVDLTFDDEALKTVAHLAIERKTGARGLRGIMESILSHEMYSIPSDDSIGSVTVTGKDFEIIRGEKPAEEISA

SEQ ID NO: 2805 - protein, 365 aa, Unknown
  Description of Unknown: uncultivated organism sequence
  Category: MG90 effectors
  Description: MG90-131 effector
MYKRQIKTPAEIKEGLDQYVIGQDEAKRVLAVSVYNHYKRILSGKGADVELQKSNVLLLGPSGVGKTLLAQTLAKMLGVPFAIADATTLTEAGYVGEDVENILLKLIQAADFDVQKAQIGIIYIDEIDKITRKSENPSITRDVGGEGVQQALLKILEGTVSNVPPQGGRKHPQQEFIQIDTTNILFICGGAFDGLDKYILRRTDKSALGFGSALKDNSSEAEKALLRKVEPHDLVKFGLIPELIGRLPVITVLDDLDEDALVRVLKEPRNSLVKQYKELLSMDNVELDITDEALHAIARKTIERKTGARGLRSVMENILMPIMYDVPNDPTIIRVTIDEDTVEGGEAHMEYGAVRKRYKSQTSLS

SEQ ID NO: 2806 - protein, 508 aa, Unknown
  Description of Unknown: uncultivated organism sequence
  Category: MG90 effectors
  Description: MG90-132 effector
MGGGRRHTGNRNQGDPNLYAQRYGAKAPLEWTEAHARVLLLADQLWDDLRAIWIQCLHEQEMVEDATGDAELLSARGAVSRTEAQVDAAFQARRDWRQRHRSKQAPEEIEASIKAAISAAREARRELWPVLKRVRKEIREELLDLWNARDQQMRVLAQGRTRKYTDLHDGVYNDIFKRFRVAAKEGAKQGIVPRPSHEHLSQSIYRQIQPHNFGGKLVSDPKKPGKRRKRIGGSQKGAEWSTLCTTGCGKVRVLPYSPGPRVTQRWGLLVMPVDANGLEIKIPIRVDDREPPQGAQIKGVRVVRRDRKWHTVFSVDAPPPSIERGAGTLYAGLNWRLMADGSLRVLDGIDETGKRYQVCLPRWQLAAVEYAEALQAATDRRAVQAALQLEEDHPKRAKEIAEAVRRRNWAALYPLDPAWADGTHGKQGRRQHTALLRARKIAGGDLAKLTELVAEILGDRAGRRRIAGQKSKNTRRREKFSRECAQAIATRITRLQNAKGDPRTGTTR

SEQ ID NO: 2807 - protein, 354 aa, Unknown
  Description of Unknown: uncultivated organism sequence
  Category: MG90 effectors
  Description: MG90-133 effector
MQLATPSQIKAHLDQYVIGQDEAKRTLAVAVYNHYKRLKQNKKSDVEIQKSNILMIGSTGSGKTYLAQSLAKMLGVPFAIADATTLTEAGYVGNDCETMLRTLLQNANYDIESAQRGIIYIDEIDKISRKGENVSITRDVSGEGVQQALLKIIEGTISEVPVTGSRKHPQAETVKIDTSNILFICGGAFDGIDKIIGKEETHNSIGFGANVADKKESVTDLSKVEQHDLVKYGLMPELIGRLPIITALNPLSEEDLVHILTEPKNAITKQYQELLSMDGVKLEFEDAALRKIAELAIKKKTGARGLRSIIESAMQKVMFDVPDMAGAKKVVVTSAFVEGKADAFVYGARNKKIA

SEQ ID NO: 2808 - protein, 383 aa, Unknown
  Description of Unknown: uncultivated organism sequence
  Category: MG90 effectors
  Description: MG90-134 effector
MSFDELPRPSDIRKNLDDYIIGQERAKIVLSVAGYNHYKRILHGQDDGVELQKSNILLIGPTGSGKTLFAQTMAKMLDVPFAIADATTLTEAGYVGEDVENILLKLLQAADFDVERAQRGIIYIDEIDKIARKSENTSITRDVSGEGVQQALLKIVEGTVANVPPQGGRKHPHQEFIQVNTKNILFICGGAFDGLEKIIERRVEEKSIGFDAPVYSRKEQDVGKLLLQVQPHDLLKFGIIPELVGRLPVIASLNALTRDDLVQILTEPKNALVKQYQKLMEYDDVELEFEPEALTAIADKAIARNIGARGLRAIMEGMLTQIMYDIPSDPTIVKAVITKDCVEGTGKPVLTRDPDKISYSVKLNTGKSGDAKASTDADPASAS

SEQ ID NO: 2809 - protein, 394 aa, Unknown
  Description of Unknown: uncultivated organism sequence
  Category: MG90 effectors
  Description: MG90-135 effector
MLIEQEGKADSKKSKGKHEDEHELIKPADLKAVLDKYIVGQDEAKKTICVSVYNHYKKNFCGDDAKADEIELQKSNVLLLGPTGVGKTMIAQTLANILKVPFAIADATTLTQAGYVGEDVENVLLRLIQAADYDIEAAEHGIIYIDEIDKITRKSENTSITRDVSGEGVQQALLKIIEGTVSNVPPQGGRKHPNQEFIQINTKNILFICGGAFEGIDKLIMQRTSSSALGFGADVKSKQENKINEALHQVEPEDLVKFGIIPELVGRLPVIAVLDDLDEDALVKILSEPKNAILKQYKYMFSLDNIELEITDDAMRAIAKKAAERKTGARGLRTVVEEALSDTMFNAPSDESITKVVLTGECVTEGKKPEIIRDTNAAKLKKSADKKALKKNAG

SEQ ID NO: 2810 - protein, 728 aa, Unknown
  Description of Unknown: uncultivated organism sequence
  Category: MG91 effectors
  Description: MG91-1 effector
MAEEKQMRSYNIQINPDADAIKVIERDMKLMEQLYGFIIYRIESHIQQLREETEYGEYDSNYKEYCLLLAEAEQKKRQCEVFRDAKKRKNIEDPELESQYNELSAEIDKLKKHKNEWCSKCCEFFRSNRKALCHFVFESRRKVIRLKSDMVTPTENSGFILHYGVNGEPYYIYDKTYYMMVEDSIRKANKGDGYSALVCECGVVTKRVSLNEDKTFKDKVYDGVAVLTDDGEIIMPYEYLRIDNLNKNNAHGFSRLFVNEYVYSLNKNPQTKKSQKTSMTYKDYGLTSHDFDENIGNRLTLSYADFPELLSQKHRKNDFMTIMSGQQSKLMDIMCDESGGYFVRMVTHSYGRGKKKYVDIPVLISHRNKNRIGTERDMDTKVLERKLQLLETGKTNVIGISKDVIRGKSRFCVNIFLEYAGGLGLEYNENSLNQKLGLGPVGVDPGMHQIAVYSDSLKKSTIFSLETICGGIFKQKIYECYSKIDSLQKKMSRCMDENNCKAKDEKGNFIKGKKLFKSKRYMAMQKEVSELYRRIAELKETANIFIAHKLLSYGNVFYIEDPRSAEKKRRMQGVVYDANGRVVKNRKFGRSIQKFSISGMIYKILDVIESRGGKIYWINNESAATAYVPKRDNVSHGMGERVFNWLGHKVQRDMKSGYVLSACKELEEMKGKKKYLNKPIYKVVSYDDERLLNDVDVFAESVREEMERCRDLNVEDKTIGIEKYFNKN

SEQ ID NO: 2811 - protein, 510 aa, Unknown
  Description of Unknown: uncultivated organism sequence
  Category: MG91 effectors
  Description: MG91-2 effector
MFVVELPLKVEKWQSDVLNKRYELLAKIYNYAQTKLLRQYIYLTQMDEYKKCKTKQDKSVFFKNHPFYFKGITSKITFSEYDVTNFVNKIIKKNVSSDKTYKDFGINTSITEYLGKHAWSAWKKKIYGNGKKVSFKNKDELNTISIRKKSEYFGGLDVDIEHMILSFNINGRTKTKAKKIILPINVKNLTEYEMYALKDGYDSINVVTIMRKMIRGNYKYYVQFTIEGEKPQKGRTLGKGNVGIDIGPSTVAISSLNGVTIDTLAEKCDNIEDKISDIERKMDRSRRATNPQNFTEDGQIKRIDRKKGEKREWKYSKRYVKLHNKKRELLRKQAAIRKLRHNIKANEILSLGDTFIVENNPTSAWAKRAKGVRKNKNGKIQTNKRFGKSIGNHAPAMFVTILQNKVESLKGKFVKVDPKNAASRFDFTNSDFTEHNLDERKITLSNGNTHQRDMLAAFNLQHIDLTNDDLKKYNVNEMIEDYPIFCKLEKEEIKRFINGIKISNKSNIGI

SEQ ID NO: 2812 - protein, 542 aa, Unknown
  Description of Unknown: uncultivated organism sequence
  Category: MG91 effectors
  Description: MG91-3 effector
MKKEKNNKGNYVITFPLITEPWQEDLLNKFFKHCCDIQNKLIKITLPVFNKHKDEIFKNEERILELCAKKKKSNLNEEETNELSALYEEKKNTLSVIKTDEIKGLVSYPKTIELFSEFGLGATCTKLIKDNIGGTDKKHENLKYNSTFPQIASPIAENIGKRVYCAYEKYIWGNGKIVHYKKNCNFNTVSFCVKKGCTFATVDVIKHNLLFKSSIGIHNGKTMTIPFKVKFDKCDEQQTLSEGQKYEMNALNNQEIKIIGIKRTFVRGKFKFELQLTFEGKPYSKNRTLGNGDVGVDPGVSSLTLYGKTVRQFRAPDNVKKTEQKINELQRYIKHTDKLLNPNKFNENGTLKKGDKAKWKHSNNNLKARKRKKELERQLKEKTKLSQIEFANSVLSEGNVLKIEDNDISNWNKNLKGIRKDKNGKILSNKKYGKSIKRTAPAQGLTILKRKYKSLGGTVIDINEKARATGTDHTNGIYTYRPVSQRKVTLSNGNTHHRDAHAAFNLKHYNNNTKHYDFKKMSEDYQHFCQEESNAFKRNELK

SEQ ID NO: 2813 - protein, 532 aa, Unknown
  Description of Unknown: uncultivated organism sequence
  Category: MG91 effectors
  Description: MG91-4 effector
MPVTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNIWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 2814 - protein, 484 aa, Unknown
  Description of Unknown: uncultivated organism sequence
  Category: MG91 effectors
  Description: MG91-5 effector
MAHKENQKAFVVTFPLRTEKWQEDRIDKMMRMLTTFYNDRQRKLVRRYIYLSHSKAYKESKGKGVVAFKNYMKEHGFSQYGLDAFFKADTKGALYQCGLNSMFLQYLSQCAWSAWDKKLFGKGDFVKTDKVVNIFCSRNKKERFCGFDYDLRTFTISIKSTCTKKIICSIPFVVNKNSEYELYALSQKICRIGIVRKLIRSKYKYYVQFTFDGVPYNKGRNIGTGIVGIDPGPSKIAIVGDNKVEIAKLAPNIEEDERKTARLKRKLDRSRRATNPHMYKEDGTIIKGQRQTCFSKAYNETRKQLADAQRKLTAKRKIAHNELANTLLEYGDTFKVEANSYKSMQARAKATSMTKSGRIRSKKRYGKSIKNRAPSEFLVILKNKLLHYPNGKYYAVPASYACTQFDFTNESFTEHKISERKIVTSDGIQHNRDTLAAFNIKNAIVNDTSTKKKKVTKSKEFFDIVKMKASYNEYCVMERYLLSV

SEQ ID NO: 2815 - protein, 490 aa, Unknown
  Description of Unknown: uncultivated organism sequence
  Category: MG91 effectors
  Description: MG91-6 effector
MAHKENQKAFVVTFPLRTEKWQEDRIDKIMRMLTTFYNDRQRKLVRRYIYLSHSKAYKEAKSKGVVAFKNYMKENGFSLYGLDAFFKADTKGALYQCGLNSMFLQYLSQCAWSAWDKKLFGNGDFVKTTKVVNIFCSRNLKGKFCGFDYDLSTFTIRIKSTCTKKIICTIPFVVNEKSYYELFALSQKICRIGIVRKLIRSKYKYYVQFTFDGIPYNKGRNIGTGIVGIDPGPSKIAIVGDNKVEILKLAPNIEEDERKTARLKRKLDRSRRATNPHMYKEDGTIIKGQRQTCFSKAYNETRKQLADAQRKLAAKRKIAHNELANTLLEYGDTFKVEANSYKSMQARAKATSVTKSGRIRSKKRYGKSIKNRAPSEFLVILKNKLLYYPKGKYYDVPASYACTQFDFTNESFTEHKISERKIVTSDGIQHNRDTLAAFNIKNSIVNDTSTKKKKITKSKEFFDIKKMKASYNEFCIMEHTSFQYKEIMEL

SEQ ID NO: 2816 - protein, 524 aa, Unknown
  Description of Unknown: uncultivated organism sequence
  Category: MG91 effectors
  Description: MG91-7 effector
MNEVFVLELPLQVEKYQADILNKRYEQLRQLYNYVQGKLLRQYRYFEQMKEYQACKTIKEKNDFFKSHPFQVNESLGGDKSAFEISFNEFSIKGFIEKLVQKSAGANMTYADLGFTTNILDHLGASVWAAWDKKLYDFKAKRISFKKYGELDSFSCRRKVVGGKVYFSGMELHLDTMELAIKMNGKQGKNAKFITLKMLYNPKHADYEMWALKGGVDSVKVVKVVRRLVRSQYKYYVQLTIEGEKPQKGRMLGKGNVGIDLGPTTVAVSGENVVSIDKLASKCDNIQEEITRLSRKIDRSRRANNSQNFNEDGTIKRGIKLVWNDSKRYKELRRELAELRRKQAAIRKQQHIDRANALLKEGDTFIVENNQISGWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYDEAEAKQYDTGAMAADYERFCQLEQEEIQRYKNKEKKDNRGTIGAEKL

SEQ ID NO: 2817 - protein, 483 aa, Unknown
  Description of Unknown: uncultivated organism sequence
  Category: MG91 effectors
  Description: MG91-8 effector
MAHKENQKAFVVTFPLRTEKWQEDRIDKMMRMLTTFYNDRQRKLVRRYIYLSHSKAYKEAKGKGVVAFKNYMKEHGFSQYGLDAFFKADTKGALYQCGLNSMFLQYLSQCAWSAWDKKLFGKGDFVKTDKVVNIFCSRNMKGRFCGFDYDLSTFTISIKSTCTKKIICTIPFVVNKKSDYELFALSQKTCRIGIVRKLIRSKSKYYVQFTFDGVPYNKGRNIGTGIVGIDPGPSKIAIVGDKKVELRKLAPNIIEDERKTARLKRKLDRSRRATNPHMYKEDGTNIKGQRQICFSKAYNETRKQLAEAQRKLAAKRKIAHNKLANTLLEYGDTFKVEANSYKSMQARAKTTSMTKSGRIRSKKRYGKSIKNRAPSEFLVILKNKLLRYPKGKYYDVPASYACTQFDFTNESFTQHKISERKIVTSDGIQHNRDTLAAFNIKNAIVNDTSKKKKITKSKEFFDIVRMKASYNEFCLMERYLLSV

SEQ ID NO: 2818 - protein, 521 aa, Unknown
  Description of Unknown: uncultivated organism sequence
  Category: MG91 effectors
  Description: MG91-9 effector
MAKEVFVIEFPLKVEKWQSDILNKRYEHLRQLYNYVQGKLLRQYIYFTQMGEYKACKSLKEKKDFFKEHIFHFKGIVGRNKKPLDISFTQYGISGLVSKLGQFSIGGKTYNDIGIGSTILANLAANVWASWDKRLYDIECERISFKKYGELNTFGSGKINKKYFCGFDLHLDRMKLDIKINGRTGKQAKFISLPIRYNLKHVDYEMNALAGGFDSIKVLTVVRRMVRGQYKYYLQMTIEGVKPQKGRHLGKGRVGIDIGPTTIAVSSNSTVSIDKLAAKCDNIEKDIQRINRKLDRSRRTMNPDNFNENGTIKRGVHLIWNNSENYKALRRQKAELQRKQAAVRKMQHIERANSLISEGDTFIIESNPIKGWTARAKETKISEKTGRIQKKKRWGKSVANHAPSMFITILENKVKSLGGTVIKADVKNAASQYDFTDGTFTKHELDERGVTLSNGDTHQRDMLSAFNLQHLIYDAKELKQYDQQRMKSHYPRFCELEQDEIERYRNKVKKDDRCTIAASRL

SEQ ID NO: 2819 - protein, 528 aa, Unknown
  Description of Unknown: uncultivated organism sequence
  Category: MG91 effectors
  Description: MG91-10 effector
MNEVFVLELPLQVEKYQADILNKRYEQLRQLYNYVQGKLLRQYRYFEQMKEYQACKTFKEKRDFFRSHPFHIDGILGSNKELFDITFDEYGINGFVGKLGKKQVSAGVTYADLGITSTLLDRLSLAVWAAWEKMLYDYHARRVSFKKYGELNIFGSRKKTNGSGKKMFSGMELHLEKMEVAIKLNGKVGKAAKFITLPILHNPKHVDYEMWALKGGFDSVTVLTIVRRLVRSQYKYYVQLTIEGEKPQKGRTLGKGNVGIDLGPTTVAVCGENVVSIDKLASKCDNIQEKITRLSRKIDRSRRANNPQNFNEDGTIKRGIKLVWKKDKDLKRYSKLKRELAELRRKQAAIRKQQHINRANALLKEGDTFIVENNQISSWTTRAKETKVNEKTGRIQKKKRFGKSVANHAPSMFINILENKVKSLGGKVVKVDTKNAASQYDFTDGSFTKHELKERNVTLSNGDMHQRDILAAFNLQHLKYDEAEAKQYDTEAMSADYERFCQLEQEEIQRYKNKEKKDDRGTIGAEKL

SEQ ID NO: 2820 - protein, 530 aa, Unknown
  Description of Unknown: uncultivated organism sequence
  Category: MG91 effectors
  Description: MG91-11 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFITQLKSKAASAGLKVTEVNPYKLRLSQYDPYTDTYRKKDLSERWQEMKAGSGQYIQRDVLSALLLYCANIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 2821 - protein, 530 aa, Unknown
  Description of Unknown: uncultivated organism sequence
  Category: MG91 effectors
  Description: MG91-12 effector
MTFQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGLYIQRDILSALLLYCADIEKEIHIPKVAVEQLEGTKQFLTDAGYVVLKSTSSRDQRDPRLASEPKAMTPEMARQKIFRGAGDSHLPTDQELGQIRAGGKVSTWSKETFPLQRGVV

SEQ ID NO: 2822 - protein, 484 aa, Unknown
  Description of Unknown: uncultivated organism sequence
  Category: MG91 effectors
  Description: MG91-13 effector
MAHKENQKAFVVTFPLRTEKWQEDRIDKIMRMLTTFYNDRQRKLVRRYIYLSHSKAYKEAKSKGVVAFKNYMKENGFSLYGLDAFFKADTKGALYQCGLNSMFLQYLSQCAWSAWDKKLFGNGDFVKTTKVVNIFCSRNLKGKFCGFDYDLSTFTIRIKSTCTKKIICTIPFVVNEKSYYELFALSQKICRIGIVRKLIRSKYKYYVQFTFDGIPYNKGRNIGTGIVGIDPGPSKIAIVGDNKVEILKLAPNIEEDERKTARLKRKLDRSRRATNPHMYKEDGTIIKGQRQTCFSKAYNETRKQLADAQRKLAAKRKIAHNELANTLLEYGDTFKVEANSYKSMQARAKATSVTKSGRIRSKKRYGKSIKNRAPSEFLVILKNKLLYYPKGKYYDVPASYACTQFDFTNESFTEHKISERKIVTSDGIQHNRDTLAAFNIKNSIVNDTSTKKKKITKSKEFFDIKKMKASYNEFCIMEHHLLSV

SEQ ID NO: 2823 - protein, 484 aa, Unknown
  Description of Unknown: uncultivated organism sequence
  Category: MG91 effectors
  Description: MG91-14 effector
MAHKENQKAFVVTFPLRTEKWQEDRIGKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNMKGRFCGFDYDLSTFTIRIKSTCTKKIICTIPFVVNKNSEYELYALSQKICRIGIVRKLIRSKYKYYVQFTFDGVPYNKGRNIGTGIVGIDPGPSKIAIVGDKKVEIAKLAPNIIEDERKTARLKRKLDRSRRATNPHMYKEDGTNIKGQRQICFSKSYNETRKQLADAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGIQHNRDTLAAFNIKNAIVNDSSAKKKKITKSKEFFDIVRMKASYNEFCLMERYLLSV

SEQ ID NO: 2824 - protein, 511 aa, Unknown
  Description of Unknown: uncultivated organism sequence
  Category: MG91 effectors
  Description: MG91-15 effector
MEKEFFVIELPLKIEKWEADLINKRYELLRSIYNYAQNKLLRQFKYFEQMTEWKNCKTKKNKSDFFKKHPFYFKGISSKITFSEYDITAFVEKLIKKQVSSNKTYKDFGINSSIAESIGKHIWSAWEKKIYNKGEKISFKKKGKLNSISVRKKSGYFGGIDVDLENMLLRLNINGKIGKKSNKITLPIVFDKPTEYEMYSFKNGIDSINVVTIVRKLIRGNYKYYVQFTIEGKKPQKGRVLGKGKVGVDVGPSTVAVSSINGVQIITLAEKCDGIEHKCKLLERKMDRSRRATNPQNYNDNGTIKKIKNEHLKWVYSKRYSKIRNKKCELQRKQAAIRKLQHNINTNELLKFGDSFIVENNPISAWQHKAKETKINKNGKIQSKKRFGKSIANHAPAMFITILENKVKSLGGELIKVDIKNAASRFDFTNSDFVEHKLNERKITLSNGNTHQRDLLAAFNLQHLNSDDESLKSYNIEEMKKDYPIFCKLEETEIDKFVNGQKKSHKYTVGY

SEQ ID NO: 2825 - protein, 530 aa, Unknown
  Description of Unknown: uncultivated organism sequence
  Category: MG91 effectors
  Description: MG91-16 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAEQGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKAFAGKIQVAGSNNFNEAASRCLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKIFRGAGDSHLPTDQELGQIRAGGKVSTWSKETFPLQRGVV

SEQ ID NO: 2826 - protein, 484 aa, Unknown
  Description of Unknown: uncultivated organism sequence
  Category: MG91 effectors
  Description: MG91-17 effector
MAHKENQKAFVVTFPLRTEKWQEDRIDKIMRMLTTFYNDRQRKLVRRYIYLSHSKAYKEAKGKSVVAFKNYMKENGFSQYGLDAFFKADTKGALYQCGLNSMFLQYLSQCAWSAWDKKLFGNGDFVKTTKVVNIFCSRNQKGKFCGFDYDLSTFTIRIKSTCTKKIICTIPFIVNKKSDYELFALSQKICRIGIVRKLIRSKYKYYVQFTFDGIPYNKGRNIGTGIVGIDPGPSKIAIVGDNKVEILKLAPNIEEDERKTARLKRKLDRSRRATNPHMYKEDGTTIKGQRQTCFSKAYNETRKQLADAQRKLAAKRKIAHNELANTLLEYGDTFKVEANSYKSMQARTKATSVTKSGRIRSKKRYGKSIKNRAPSEFLVILKNKLLYYPKGKYYDVPASYACTQFDFTNESFTEHKISERKIVTSDGIQHNRDTLAAFNIKNSIVNDTSTKKKKITKSKEFFDIKKMKASYNEFCIMEHHLLSV

SEQ ID NO: 2827 - protein, 525 aa, Unknown
  Description of Unknown: uncultivated organism sequence
  Category: MG91 effectors
  Description: MG91-18 effector
MNEVFVLELSLQVEKYQADILNKRYEQLRQLYNYVQGKLLRQYRYFEQMKEYQACKTFKEKRDFFRSHPFHIDGILGSNKEPFDITFDEYGINGFVGKLGKKQVSTGVTYADLGITSTLLDRLSLAVWAAWDKMLYDYHAHRVSFKKYGELNIFGSRKKTNGSGKKVFSGMELHLEKMEVAIKLNGKVGKAAKFITLPILHNPKHADYEMWALKGGFDSVTVLTIVRRLVRSQYKYYVQLTIEGEKPQKGRTLGKGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIDRANALLKEGDRFIVENNQISGWTTRAKETKVNERTGKIQKKKRFGKSVANHAPSMFVSILENKVKSLGGEVVKVDTKNAASQYDFTDGSFTKHELKERNVTLSNGDTHQRDMLAAFNLQHLKYDEAEAKQYDTEAMAADYERFCQLEQEEIQRYKNKEKKDDRGTIGAGDL

SEQ ID NO: 2828 - protein, 494 aa, Unknown
  Description of Unknown: uncultivated organism sequence
  Category: MG91 effectors
  Description: MG91-19 effector
MARENEDSGCFVVTFPLKTEKWQEDRIDKILNLLTVRYREKQKTLLDRYIHLSHSPEFKEAKNAGLKAFRDFMNEHKFTKFDIQKVFSDSSLSKSATTDVMLTHGINSDIMEELSHRAWSAWEKKLYGQGKFIRLDNEVNIFKSRRHKEHITGFEYSFTDMTLSMNATKPKKHTMFTIPFVVNRKREYEAYALGCEVRNIAIVRQQIRGKNKYYVQFSFAGTPYNKGRKIGTGIVGIDPGPSKIAIVSDSEIRITTLAPSVKRDERAVCRMQRKLDRSRRATNPDNYNDDGTIKRGIKLKFEKSNSYKRTQAKLADMQRKLAAKRKIDHNILANEIITMGNEFHVENNSFKSMQARSKETKKNDKGKNLSKKRFGKSLANRAPSELLTILKNKVCQYADGEYVDIPSGVSCTQFDFTNGEFTKHELKERIITTSDGFVHDRDALAAFNMRFVNRQRIEGKKKVEKDKENFDLQAMTKAYKQFCALEENIKNRDK

SEQ ID NO: 2829 - protein, 375 aa, Unknown
  Description of Unknown: uncultivated organism sequence
  Category: MG91 effectors
  Description: MG91-20 effector
MLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKIFRGAGDSHLPTDQELGQIRAGGKVSTWSKETFPLQRGVV

SEQ ID NO: 2830 - protein, 528 aa, Unknown
  Description of Unknown: uncultivated organism sequence
  Category: MG91 effectors
  Description: MG91-21 effector
MNEVYVLELPLRVEKYQADILNKRYEQLRQLYNYVQGKLLRQYRYFEQMREFQDCKTFKAKREFIKSHPFHVNGVIGRNKELLDIFFDEYGIQGFVAKLGQKPIGSGMNYTDMGISSTILANLSANIWSAWNKKLYDYRAERIAFKRYGGLNTFGSGKIVQKKDGEVKEYFPGMVLRLESMELDIKTNGKLGKNAKFITLPILHNPKHADYEMWALKGGMRSVKVLTVVRRMVRNQYKYYLQMSIEGEKPQKGRTLGKGNVGIDLGPTTVAVSGENIVSIDKLASKCDNIQKEITRLARKIDRSRRANNPQNFNEDGTVKRGIKLVWNDSNRYKELRREMAELQRRQAAIRKQQHIDRANELLKEGDTFIVENNQISGWTRKAKETKVNEKTGKIQKKKRFGKSVANHAPAMFVTILENKVKSLGGEVVKVDTQNAASQYDFTNDSFEKHELKERSVTLSNGDTHQRDMLAAFNLQHLKYDDKEKKQYDTEAMKEHYERFCEMEQEEITRYKNKEKKDDRTTIGASDL

SEQ ID NO: 2831 - protein, 383 aa, Unknown
  Description of Unknown: uncultivated organism sequence
  Category: MG91 effectors
  Description: MG91-22 effector
MFLQYLSQCAWSAWDKKLFGKGDFVKTDKVVNIFCSRNMKGRFCGFDYDLSTFTIRIKTTCTKKIICTIPFVVNKNSEYELYALSQKICRIGIVRKLIRSKYKYYVQFTFDGVPYNKGRNIGTGIVGIDPGPSKIAIVSDEKVEIAKLAPGIEEDERKTARLRRKLDRSRRATNPHMYKEDGTIIKGQRQTYFSKVYNETRKQLADAQRKLAAKRKIAHNELANTLLEYGDTFKVEANSYKSMQARTKATSMTKSGRIRSKKRYGKSINNRAPSEFLVILKNKLLYYPKGKYYDVPSSYACTQFDFTNESFTEHKISERRIVTSDGIQHNRDTLAAFNIKNAIVNDTSTKKKKITKSKEFFDIVKMKASYNEFCVKERYLLSV

SEQ ID NO: 2832 - protein, 543 aa, Unknown
  Description of Unknown: uncultivated organism sequence
  Category: MG91 effectors
  Description: MG91-23 effector
MEKEMFVIEFPLKVEKWQADILDKRYEHLRKIYNYAQGKLVRQYDYLTQMKEYRRHGFSKEYEGMLVERGYEKALRAIKAAKDQFFRNHPFHVSGVSDSSGKPMNITFSSFGIPGFIEKLASHRIGADTTYGDLGINSIILGLLGKQLWSAWDRMINDPNTEKVSFKKYGELNSFATRVKGKEGKKVSSGMNLYLDTMTLDIKVNGKTGRNAKFISLPIVYNLKHADYEMNALHGGLESIKVIKVLRRLVRGKYKYYLQLTIGDEKPQKGRQLGKGRVNIDLGLTKIAVYSDAGVMVRPLAPSTEKIDHQILLVQRKMDRSRRANNPGYFNADGTIKELEKGERRRWMNSEEYKRLRMQKAELQRRQAAVRKQDHISLANELLKLGNLFVIEDNDVKEWQQRKKEAIRREEDGKNLSQAGFGKHVANHAPAMFVTILENKVKSLGGTLVKVDTNNGATEYDFTNDTFTKHDLTERYITLSDGKRHQRDTLAAFNLGFLNLDPQKKRSYNRENMRGHYDRFCQMEEIALKSYRSQSAVGAVNNL

SEQ ID NO: 2833 - protein, 484 aa, Unknown
  Description of Unknown: uncultivated organism sequence
  Category: MG91 effectors
  Description: MG91-24 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDSGPSKIAIVGDNKVEIAKLAPNIEEDERKTARLKRKLDRSRRATNPHMYKEDGTIIKGHCQTCFSKVYNETRKQLADAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSTKKKKITKSNEFFDIVRMKASYNEFCLMERYLLSI

SEQ ID NO: 2834 - protein, 607 aa, Unknown
  Description of Unknown: uncultivated organism sequence
  Category: MG91 effectors
  Description: MG91-25 effector
MAKEEFVLTLPLKVEKWQADILDKRYELLRQVYNMVQQKLVRQYIYFSQQKAYRDCKSFEQKREFFENHPFHIKGVKGRNGELCDVKFPYTYRSRGGPSGKRAPNGISDFVSKLGSRKIGEDKTLADFGINSIILEELGLHIMRAWETRLYKPKSSRVSYREYGDINSFGSRKINTNFTGFTINIEDRYIAFNTNGRRGQFADFIQLPIDFSREKNGYAREALNGGIESLKKLLIVRKCIRGGNKYYLQLTISGEKPQKGRTLGKGNVGIDIGPSTIATSSLKGVHFDKLADKCDNIEHELYLINRKLDRSRRANNPQNYNEDGTIKRGIRLVWKKDKDAKRYATLKQQRKELYRKQAEIRKQQHLEMANAMLSQGDTFIVENNPIDAWVRRAKETTKTKTGKNRCKKRYGKSVANHAPSMLVSILKNKVLSLGGNFYEIDPRNAATQFDFTNGEFTKHEVSERSITLSNGCSHQRDMLSAFNLQHIVLQSKELKEYDIEQMEADYPIFCRLESAEQERFKDARHKERDALYYVGASKKQMRRNPQEKSVANRHNGGVGRKHCNTSLGNENAEITGSGLARESIERVSQVPDEYHPFGCDPIVLDGL

SEQ ID NO: 2835 - protein, 521 aa, Unknown
  Description of Unknown: uncultivated organism sequence
  Category: MG91 effectors
  Description: MG91-26 effector
MAKEVFVIEFPLKVEKWQADILNKRYEHLRRLYNYVQSKLLRQYIYFTQMQDYKKCKTLKEKKNFFKEHVFHIKGILGRNKSPLDITFTEYGILGMVTKLSQLSMGGKSYSDIGIGFTILANLADNIWAAWNKRLYDFECERISFKKYGSLDTFGSGKINNKYFCGFDLHLDRMTLDIKINGRTGKQAKFISLPIRYNMKHVDYEMNALAGGFDSIKVLTVVRRMVRGQYKYYLQMTIEGVKPQKGRHLGKGRVGIDIGPTTIAVSSNSTVSIDKLAAKCDNIEKDIQRINRKLDRSRRTMNPDNFNEDGTIKRGVRLIWNNSENYKALRRQKAELQRKQAAVRKMQHIERANSLLSEGDTFIVENNPIKGWAAKAKETKVSEKTGKIQKKKRWGKSVANHSPAMFVTILENKVKSMGGTVIKADVKNAASRYDFTDGSFTKHDLDERGVTLSNGDTHQRDMLAAFNLQHLIYDAEKPKQYDQLRMKSHYPRFCELEQDEIERYRNKVKKDDRCTIAASRL

SEQ ID NO: 2836 - protein, 530 aa, Unknown
  Description of Unknown: uncultivated organism sequence
  Category: MG91 effectors
  Description: MG91-27 effector
MTSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHREAAAERKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCANIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 2837 - protein, 526 aa, Unknown
  Description of Unknown: uncultivated organism sequence
  Category: MG91 effectors
  Description: MG91-28 effector
MNEVFVLELPLQVEKYQADILNKRYEQLRQLYNYVQGKLLRQYRYFEQMKEYQACEKIKEKRDFFRSRPFQINETLKGIETPVKLSFEEYSIKGYIEKLVQKSVGANMTYADLGFTTNILDYLGAGVWAAWDKKLYDFKAKRVSFKKYGELDSFSSRRKVVRGVVYFSGMELHLDTMELAIKMNGKVGKESRFITLKMLHNPKHADYEMWALKGGVESVKVVKVVRRLVRSQYKYYVQLTIEGEKPQKGRTLGKGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIERANALLKEGDTFIVENNKISSWTTRAKETKVNEKTGKIQKKKRFGKSVANHAPSMFVSILENKVKSLGGEVVKVDTKNAASQYDFTDGSFTKHELKERNVTLSNGDIHQRDMLAAFNLQHLKYEEAEAKQYDTKAMADDYERFCQLEQEEIQRYKTKEKKDDRGTIGAEKLIK

SEQ ID NO: 2838 - protein, 524 aa, Unknown
  Description of Unknown: uncultivated organism sequence
  Category: MG91 effectors
  Description: MG91-29 effector
MTEVFVLELPLQVEKYQADILNRRYEQLRQLYNYVQGKLLRQYRYFEQMKEYQACKTFKDKKDFLKKHPFQVKGVYGSNKELLDITFDEYGIQGFVSKLGKKCVCSNTTYADLGITSTILDRLSLAVWSSWEKMLYSFQTKRLSFKKFGELDTISNRRIVARGKVCFPGMELHLEKMELAIKLNGKTGKNAKFITLPILHNPKHADYEMWALKGGIDSVKVITVVRRLVRGQYKYYVQLSIEGEKPLKGRTLGKGNVGIDLGPTTVAISGNNNVSIDKLAPKCDNTQREITRLSRKIDRSRRANNPQNFNEDGTIKRGIRLVWNDSKRYKALRRELAELQRRQAAIRKQQHIDRANELLKEGDTFIVENNSISGWAAKAKETKVSEKTGKIQKKKRFGKSIANHAPAMFVNILENKVKSLGGQVVKVDTKNAASQYDFTDNSLEKHELNERNVTLSNGDTHQRDMLAAFNLQHLKYDAKESKQYDVEAMNKDYDRFCQLEEAEIMRYKNKEKKDDRSTIGVGKL

SEQ ID NO: 2839 - protein, 353 aa, Unknown
  Description of Unknown: uncultivated organism sequence
  Category: MG91 effectors
  Description: MG91-30 effector
MKKSVSIKVAAKVNTNISDEKPKDLRNRFLSTQNYRLLSAVSRFATDYVQGIIRVNDLVEMKCNELKGQDLIDSAVCQGDCRKKFSKGAKYLFCVVDSAADVNDVAVRWNKFKLVCNTCSNDYAFNAQYEVMQLYPTVSLADVERLCAVGFLTKYIFPINLEYTESRTETEVPGYHNFYKIVKSIVKDKKHNEQITKIQLCTYGRDLFTETDYDCAMKSGVDAYGGMTFELDFYPHDSNMMTFLETYKDTKPLTYFYRVTKRIYSSRFDYVVYFPIKCTRYCKFCKASKIYAKNNPVLYCSQCGFTDAMFFKNSPLLSTVTFFDECVKSKTLKPKRIFYYDMALYKTMIKKVK

SEQ ID NO: 2840 - protein, 527 aa, Unknown
  Description of Unknown: uncultivated organism sequence
  Category: MG91 effectors
  Description: MG91-31 effector
MNEVFVLELPLQVEKYQEDILDKRFEQLRQLYNYVQGKLLRQYRYFEQTKEFQACKTIKEKRDFFRNHPFHFNGIYGNNNELFNITFDEYGVNGFVSKMAKKQVGANMTYADLGITTTLLDRLSLAIWASWEKKMYDYHTKRISFKKHGELNIFGSRKKTNGSGKKMFSGMELNLERMEVSIKLNGKVGKKAKYITLPILHNPKHVDYEMMALKGGFDSVKVITVVRRLVRGRYKYYLQMSIEGEKPKKDRTLGKGNVGIDIGPTTVAVSGENIASIDKLASKCDSIEAEKARLGRKIDRSRRANNPQNFNEDGTIKRGVRLVWNDSKRYKVLRREMTELQRRQAAIRKQQHIDRANELLKEGDTFIVENNQISGWTRKAKETKVNEKTGKIQKKKRFGKSVANHAPSMFVTILENKVKSLGGQVVKVDTKNAASQYDFTNDSFEKHELNERSVTLSNGDTHQRDMLAAFNLQHLKYDAQEKKQYDREAMTQHYDRFCKLERAEIMRYKNKEKRDDRSTIGAGELNT

SEQ ID NO: 2841 - protein, 525 aa, Unknown
  Description of Unknown: uncultivated organism sequence
  Category: MG91 effectors
  Description: MG91-32 effector
MNSDTFIMELPLIVEKFQSDELDKRFEILRRIYNMAQNKLERQFCYLSKFKEYQECTTKKAKGEFIKKHPFSFKDILDKSGNPLMITFTKYDIQGYLSKFAKLKIDSQYTYSDMGINTSMLMHMGMAIWSAWEKVIFDSKADKISYKKYGDLKSIGVDWEPKHPAGFILNLRKGELKLNLNNRQGQYARYITMKIRFGKKEHQVWYEGDALNAGEDSIRVLTIVRRKIRGRYNYYLQMTIRNNKPQKGRTLGEGRVAIDLGTSKIAVVAKDKVHLLPLSPSILSVSDELRIIQRQMDRSRRANNPHKYHEDGTVKKGNHDKWVNSKEYIRLRNMKAELERKQAAVRKQDHIALANYLLSLGNEFVIEDNDVQEWAKRKKEEKRRKSDGKNLSKAGLGKQIGNHAPSMFVTILKNKVESLGGTFVKVDNNNRATDYDFTNNTFNEHKLEERYITLGNGNRHQRDTLAAFNLYHLDTAPEKEKCYNLYEMRKHYAQFCEFEKEALLRWKGMTPKREKMKVREHERGL

SEQ ID NO: 2842 - protein, 607 aa, Unknown
  Description of Unknown: uncultivated organism sequence
  Category: MG91 effectors
  Description: MG91-33 effector
MAKEEFVLTLPLKVEKWQADILDKRYELLRQVYNMVQQKLVRQYIYFSQQKAYRDCKNFEQRRGFFEAHPFHVKSVKGKNGELCDIKFPYTYKSRGGSSGKRAPNGISDYVSKLWSHKIGQNKTLADFGINSYIMEELGLHIMKAWEDRLYKPKSKRVSFKDYGEINSFGSRNKNGNFAGFTINLDNGIITYKTNGRQGQFADLIQLPIDFSREKNGYASEALKGGIESLKKLLIVRRCIRGENKYYLQLTISGEKPQKGRTLGKGNVGIDIGPSTIATSSLNGVYFDKLADKCDNIEHELYLINRKLDRSRRANNPQNYNEDGQIKRGVRLVWKKDKDVKRYTTLKLQRKELYRKQAEIRKLQHLEMANAMLSEGDTFIVENNPIDAWVRRTKETTKTKAGKNRCKKRYGKSVANHAPAMFVSILKNKVLSLGGKFYEIDPRNAATQFDFSNGEFTKHEVSERSITLSNGRTHQRDMLSAFNLQHIVLQNKELKEYDIEQMEADYPIFCRLENTELERFKEARHKERDALYFVGASEKQMRRQPQEESVANRHNGGVGRKHCNTSLGGGNAKITGNGLARESIERVSQVPDERHLSGCVPISLDGL

SEQ ID NO: 2843 - protein, 484 aa, Unknown
  Description of Unknown: uncultivated organism sequence
  Category: MG91 effectors
  Description: MG91-34 effector
MAHKENQKAFVVTFPLRTEKWQEDRIDKMMRMLTNFYNDRQRKLVRRYIYLSHSKAYKEAKSKGVVAFKNYMKEHGFSQYGLDAFFKADTKGALYQCGLNSMFLQYLSQCAWSAWDKKLFGKGDFVKTDKVVNIFCSRNMKGSFCGFDYDLSTFTIRIKSTCTKEIICTIPFVVNKNSEYELYALSQKICRIGIVRKLIRSKYKYYVQFTFDGVPYNKGRNIGTGIVGIDPGPSKIAIVGDNKVEIAKLAPGIEEDERKTARLKRKLDRSRRATNPHMYKEDGTNIKGQRQICFSKSYNETRKQLAEAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSTKKKKITKSNEFFDIVRMKASYNEFCLMERYLLSI

SEQ ID NO: 2844 - protein, 383 aa, Unknown
  Description of Unknown: uncultivated organism sequence
  Category: MG91 effectors
  Description: MG91-35 effector
MFLQYLSQCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYNKGRNIGTGIVGIDSGPSKIAIVGDEKVEIAKLAPNIEEDERKTARLKRKLDRSRRATNPHMYKEDGTNIKGQRQTCFSKVYNETRKQLADAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSAKKKKITKSKEFFDIVRMKASYNDFCLMERYLLSV

SEQ ID NO: 2845 - protein, 530 aa, Unknown
  Description of Unknown: uncultivated organism sequence
  Category: MG91 effectors
  Description: MG91-36 effector
MTSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHREAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 2846 - protein, 614 aa, Unknown
  Description of Unknown: uncultivated organism sequence
  Category: MG91 effectors
  Description: MG91-37 effector
MAKENFVLTLPLKVEKWQADILDKRYELLRQVYNMVQQKLLRQYIYFSQQKAYKECKTFQQKREFFDSHPFYIKIDDKPCEIKFPYTKKNSNTAPNTISNYVSGLGSHRVGQDKTLSNLGINSIILEELGIHIMKAWGDRIYNSKSEHISFKKYGEVNSLVSRYKKKKQTGKVYFPGFTINLEERYITYNTNGRQGNQAKLIKLPIDFSREKKRYAAEALKDGIDSIRKLSVVRRCIRGKNKYYLQLVIDGEKPQKGRTLGRGNVGIDIGPSTIATSSLLGVHFDKLADKCDNIEHELYLIDRKLDRSRRANNPQNYNEDGTYKRGVRLVWKKDSEVKRYAKLKAARKELYRRQAEIRRRQHLEMANAMLQLGDTFIVENNPIDAWARRAKETKKTKSGRTRCKKRYGKSIAHHAPAMFVTMLENKVKSLGGEFYRVDAYGYAATQFDFTNKKFTKHAVNERSITLSNGHTHQRDMLSAFNLQHARLEGEKTKSRDKEKKVESYDIEQMQADYPIFCRLEAEEQKRFRVAWHNEKDALYFVGASGKQLRHQSQEKSAANRHNGGVDRNHCNTRLGKENAEITGSGFARESIARVSQVPDEYHQHGQQSIIIDGL

SEQ ID NO: 2847 - protein, 372 aa, Unknown
  Description of Unknown: uncultivated organism sequence
  Category: MG91 effectors
  Description: MG91-38 effector
MIRNLKIECFVRDNDLHAKIRASVRLYRACLRAAFSYCALAETAGAEIVAENGNVTVKPNDEKAREILSACVGHSGKIKYYEMYHWMKELYPSLISNCYSKIQYIIGKMMTMKDQDIKKCQKKFLIVNGKRAFAQFNRSGIPIKSGMAKIDGHLLKCRWDKDIGEVEFTTNKMDSSTYYAFSSLREGWEGWSIKDSYLSFDEDKNKIVVILSYERPDTPTNIEPEKVMHVEFTDDKEMFITCYTDDKWSARPFSAAGIIGYLEEMEQIYSRYWSEFKSYERRERKQRNHVKEKLNRYTERRANAEKNNNHLWSKRIVDFARQQCAGKLVVVNLPEKTLFDLPYGWFDFKTKLDYKMKEIGGTVSFVTVDKDK

SEQ ID NO: 2848 - protein, 614 aa, Unknown
  Description of Unknown: uncultivated organism sequence
  Category: MG91 effectors
  Description: MG91-39 effector
MAKENFVLTLPLKVEKCHADILDKRYELLRQIYNMVQQKLVRQYIYFSQQKAFKACENFDQKREFFNKHPFHFKGIKGKNGELSDIKFPYTYESRSSSSGKRPSGGISDYVAKLWSHKVGADKRLVDFGLNASIMEELGLHIMKAWEDRLYKFKAKRVSFKEYGEINTLGCRLKGNFAGFTINLEEGFITFNTNGRHGKFADLIKLPIDFSREKRGYAEDALKGGVDSLRKLVIVRRCIRGRNKYYLQLTISGEKPQKGRTLGIGDVGIDIGPSTIATSSLQGVHFDKLAEKCDNIEHELYLINRKLDRSRRANNPDNYNHDGTIKRGVRLVWKKDKDVKRYASLKQQRKELFRRQAEIRKLQHLEMANAMLSQGDTFIVENNPIDAWVRRAKETKKTKTGKNRSKKRYGKSVANHAPAMFVTILENKVKSLGGVFYKVDPGYAATQFDFTNGVFTKHEVSERSITLSNGRTHQRDMLSAFNLQHARLEVEKAKSRDKEKKVESYDIGQMQADYPIFCRLETAEQERFKNARRNERDALYFVGALAKELRHAPQEETVANRHNGGVGRKHCNTLCPENAKITGNGLVRESVARVSEAPEECYHTGDQPIILDGL

SEQ ID NO: 2849 - protein, 484 aa, Unknown
  Description of Unknown: uncultivated organism sequence
  Category: MG91 effectors
  Description: MG91-40 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSTKKKKITKSNEFFDIVKMKASYNEFCLMERYLLSI

SEQ ID NO: 2850 - protein, 484 aa, Unknown
  Description of Unknown: uncultivated organism sequence
  Category: MG91 effectors
  Description: MG91-41 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDSGPIKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARAKATSMTKSGRIRSKKRYGKSIKNRAPSEFLVILKNKLLYYPKGKYYDVPSSYACTQFDFTNESFTEHKISERRIVTSDGIQHNRDTLAAFNIKNAIVNDTSTKKKKVTKSKEFFDIVRMKASYNEFCLMERYLLSV

SEQ ID NO: 2851 - protein, 528 aa, Unknown
  Description of Unknown: uncultivated organism sequence
  Category: MG91 effectors
  Description: MG91-42 effector
MNEVFVLELPLRVEKYQADILNKRYEQLRQLYNYVQGKLLRQYRYFEQMREFQDCKTFKAKREFIKSHPFHVNGVIGRNKELLDIYFDEYGILGFVAKLGQKPIGSGMNYTDMGISSTILSNLSANIWSAWNKKLYDYRAERIAFKRHGGLNTFGSGKIVQKKDGEVKEYFPGMVLRLESMELDIKTNGKLGKNAKFITLPILHNPKHADYEMWALKGGMRSVKVLTVVRRMVRGQYKYYLQMSIEGEKPQKGRTLGKGNVGIDLGPTTVAVSGENIVSIDKLASKCDNIQKEITRLARKIDRSRRANNPQNFNEDGTVKRGIKLVWNDSKRYKELRREMAELQRRQAAIRKQQHIDRANELLKEGDTFIVENNQISGWTRKAKETKVNEKTGKIQKKKRFGKSVANHAPAMFVTILENKVKSLGGEVVKVDTQNAASQYDFTNDSFEKHELKERSITLSNGDTHQRDMLAAFNLQHLKYDDKEKKQYDTEAMKEHYERFCELEQEEIQRYKDKEKKDDRSTIGAEKL

SEQ ID NO: 2852 - protein, 524 aa, Unknown
  Description of Unknown: uncultivated organism sequence
  Category: MG91 effectors
  Description: MG91-43 effector
MIEVFVLELPLQVEKFQADILNKRFEQLRQLYNYVQGKLLRQYRYFEQMREFQACKTIKEKRDFFRTHPFHINGVLDRRGDLLDITFDEYGIQGFVEKIIHKSVSTNTSYADLGFNTLILDYLSASIWSAWDNKLYNLKTKHISFKKYGELDSFSTRKKLVKEKLYFSGIELHLDKMELAIKMNGKVGKNAKFITLKMLHNPKHADYEMWALKGGVDSVKVVKVVRRLVRSQYKYYVQLTIEGEKPQKGRTLGKGNVGIDLGPTTVAVSGENVVSIDKLASKCDNIQEEITRLSTKIDRSRRANNPQNFNEDGTIKRGIKLVWNDSKRYKELRRELAELRRKQAAIRKQQHIDRANALLKEGDTFIVENNQISGWATRAKETKVNEKTGKIQKKKRFGKSIANHAPSMFVSILENKVKSLGGEVVKVDTKNAASQYDFTDGSFTKHELKERNVTLSNGDTHQRDMLAAFNLQHLKYDEKDTKQYDTEAMTADYERFCQLEQEEIQRYKNKEKKDDKGTIGAEKL

SEQ ID NO: 2853 - protein, 527 aa, Unknown
  Description of Unknown: uncultivated organism sequence
  Category: MG91 effectors
  Description: MG91-44 effector
MNEVFVLELPLQVEKYQEDILDKRFEQLRQLYNYVQGKLLRQYRYFEQTKEFQACKTIKEKRDFFRNHPFHFNGIYGNNNELFNITFDEYGVNGFVSKMAKKQVGANMTYADLGITTTLLDRLSLAIWASWEKKLYDYHTKRISFKKHGELNIFGSRKKTNGSGKKMFSGMELNLERMEVSIKLNGKVGKKAKYITLPILHNPKHVDYEMMALKGGFDSVKVITVVRRLVRGRYKYYLQMSIEGEKPKKDRTLGKGNVGIDIGPTTVAVSGENIASIDKLASKCDSIEVEKARLGRKIDRSRRANNPQNFNEDGTIKRGVRLVWNDSKRYKVLRREMTELQRRQAAIRKQQHIDRANELLKEGDTFIVENNQISGWTRKAKETKVNEKTGKIQKKKRFGKSVANHAPSMFVTILENKVKSLGGQVVKVDTKNAASQYDFTNDSFEKHELNERSVTLSNGDTHQRDMLAAFNLQHLKYDAQEKKQYDREAMTQHYDRFCKLERAEIMRYKNKEKRDDRSTIGAGELNT

SEQ ID NO: 2854 - protein, 615 aa, Unknown
  Description of Unknown: uncultivated organism sequence
  Category: MG91 effectors
  Description: MG91-45 effector
MAKEVFVLTLPLKVEKWQADILDKRYELLRQTYNMVQQRLLRQYIYFSQQKAYKACETFVQRRDFFASHPFHFKGIKGKNGESSDIKFPYTYESRSSNTGKRPSGGISDYVSKLWSHRVGQDKTLADFGINSYLLEELGLHIMKAWEKRLYDPQSSHVSFKKYGDVNSFGSRYKKDKKSNRITFPGFAIDLVKGYIVYNTEGKRVKTNPFVLPIDFSREKKEYALESLKGGVDSIRKLLIVRRCIRGRNKYYLQLSIKGEKPQKGRTLGKGNVGIDIGPSTIAVSSLQGVHFDKLANKCDNIEHELHLLNRKIDRSRRANNPQNYNEDGTVKRGVRLVWKKDKDAKRYANLKQIRKELHRRQAAIRKQQHLEMANALLSQGDTFIVENNPVDAWVRRAKETTKTKTGKNRCKKRFGKSVANHAPATFVSILKNKVLSLGGQFHEVDIHNAATQFDFTSQQFTKHELGERSVKLSNGNTHQRDMLSAFNLQHLRAQSEENKDYDIEQMKADYPIFCKLETAEKERIKGERSVERDVLFYIGASTQDMRQQPQKSTVVNRHNGGVGRKHCNTRLGSRKKENAEITGSGLVRESIERVSQVPDEYHHFGIQSVILDGL

SEQ ID NO: 2855 - protein, 605 aa, Unknown
  Description of Unknown: uncultivated organism sequence
  Category: MG91 effectors
  Description: MG91-46 effector
MIEEFVLTLPLKVESWQADILNNRYEHLRRIYNMVQRKLLRHYIYLSQQNEYRQCKDNDEKRTFWENHPITFKDFCDKNGNPAIVKFPYTYSHRSKDSGKKASNGISDFVPKFKNRNIGGGLTYGSLGINASILENLGLRIEQAWKKRLYDPKSKHISFKEEGDLNTLGCREKNGFSGFVLDLQKMTLSFNTNGRQGKSAKFIHFPINAGKELTEYEMYALKGGIGSIRKIVVSREYVRGRYKYYVQLTIKGEKPQKNRTLGKGTVGIDVGPSTVAVSSLHGVSLDKLADKCDNIEHDLWRINRKMDRSKHETNPDFFNEDKTYKKPEKGERRKWTFSNRYKRLKLERRELYRKQAAISKQQHIDMANALLSQGDEFIVENNPIDSWAKRAKETKRGKNGKIRCKRRFGKSVAHHAPAMFVSILQNKVRSLGGTFHKVEIKNAATQFDFTNGEFTKHELNERTVTLSNGRTHQRDMLSAFNLQHLRPDSEETKDYNIEQMEADYPVFCKLEEKGIAQFKEKRQQERDVAYFTGVSHKTLKFSSANRHNGGVGRKNCNHHAGSKRNVAETGNKSSSKEYCESMETVSLVPNEYHHSNHQHLRLDGL

SEQ ID NO: 2856 - protein, 533 aa, Unknown
  Description of Unknown: uncultivated organism sequence
  Category: MG91 effectors
  Description: MG91-47 effector
MNEVFVLELPLRVEKYQADILNKRYEQLRQLYNYVQGKLLRQYRYFEQMREFQDCKTFKAKREFIKAHPFQISGISGSNKQPLDITFDEYGIRGFVEKLAQKSAGPNVTYADLGFTTYILDHLSVSIWSAWDKMLYDYHAKRVSFKKYGELDSFSSRRKIVGGKVYFSGMELHLDTMELSVKLNGKQGANAKFITLPILHNPKHADYEMWALKGGLVSVKVVKVIRRMVRSQYKYYVQLTIEGEKPQKGRTLGKGNVGIDLGPTTVAVSGDNIVSIDKLASKCDNIQKEITRLARKIDRSRRANNPQNFNEDGTVKRGIKLVWNDSKRYKELRREMAELQRRQAAIRKQQHIDRANELLKEGDTFIVENNQISGWTRKAKETKVNEKTGKIQKKKRFGKSVANHAPAMFVNILENKVKSLGGEVVKVDTQNAASQYDFTNDSFEKHELKERSITLSNGDTHQRDMLAAFNLQHLKYDDKEKKQYDTEAMKEHYERFCELEQEEIQRYKDKEKKDDRSTIGAEKLHMNDGTVKK

SEQ ID NO: 2857 - protein, 650 aa, Unknown
  Description of Unknown: uncultivated organism sequence
  Category: MG91 effectors
  Description: MG91-48 effector
MSEKSLIVYSASLKDKKISNILDSNSIPLVYLHNIKIDILNKITNNVLKYFNTNIKGIIKSNNIDEYTKKFNIFNKKIISHPDFDKFRLNIKNNIKNNILSLPTLIKTPEFFIHEKRIDGNKQLVNTGRTITKQLLINMCGGDNAIDYTNYLNKPIKKFSIIKYYNYLFISKKEVNLTGILEMQLNSNEEENLSNFKIKCKEYFSKIDVENDEFIRVILNVTYVNDKRDKIITYITTESKNQSNYYNFVNNLKFAMFIDNETSRFTNNQISKTKYSKLHEHIDYYNYTLRIEKTAINKDTGIRKDPIPYKYEKWDNEQYKYNSIKITKGIMFYKLDDTYNHKTRNKYNIVFKLNKFFKNKLTYDSYKNLLKNNQIFDNKANINDIEFEIELIVPKDINIQTFRLVRLIKSCDIWDAHFTFEDDNKYYTNSNNNVYFDRNINNLIGIDDNSELYNIDMPQHNKKSKKLYFKIKNIQKRLSKNNNEINNKILKKYNKKRTNYKKTILQQECKKIVEKGGNIYLEKNNISNMTKSAKGNSLNNGKNVRAKSKLNRKLLDSNFKFIEEQLEKNTKRYGKKFVPINTNHSPSQHCPNCNTKYEKTNNYTYRTCSSCNLSFDRDIAANINNIKENKGHTSQQIQNHINKYKNKKIK

SEQ ID NO: 2858 - protein, 535 aa, Unknown
  Description of Unknown: uncultivated organism sequence
  Category: MG91 effectors
  Description: MG91-49 effector
MATENFVLELPLKVEKWQADILNKRYEYLRQIYNYVQRKLIRQYRYFEQMDEFRQCTTYKEKREFFKSHPFYFKDIVGRNGEPFAIKFPYSMSASSGSKMDGFSGYIAKLGKLPAGANKSYSDLGINSFMLERLASNMWAAWNKYLYDRDSKRVSFKKYRDLNTFGSRKANNTTFIGMEIHLDSMEVIIKTNGKLGKYAKYITLPIDYKHSMTEYEMFALKGGFDSIKILNVVRKEIRGREKYYVQLTIEGEKPQKGRMLGKGNVGIDLGPSTIAVSSRQKVSIDKLANKCDDIQRDLYVVSRKMDRSRKANNPQNFNEDGTIKPISRKNGERRYWNDSKRYERLRSERKELLRKQAAIRKLQHIETANALLELGDTFIVENNPVSGWTRKSKETKLNKKGRIQSKKRFGKSVANHAPAMFSTILENKVKSLGGQFKKVDVKNAASRFDFTNGEFTEHKLNERVITLSNGDKHQRDLMAAFNLQHLNLDGDLSKDYDVEMMQRDYPDFCRLEREEMDMYLQGIKKNERTTIGAFK

SEQ ID NO: 2859 - protein, 528 aa, Unknown
  Description of Unknown: uncultivated organism sequence
  Category: MG91 effectors
  Description: MG91-50 effector
MNEVFVLELPLQVENYQADILNKRYEQLRQLYNYVQGKLLRQYRYFEQTKEFQECKTFKAKREFIKAHPFQIKGVLGRNKKLLDIFFDEYGILGLVAKLGQKPIGSRKTYTDMGISSTILANLSDNIWSSWNKKLYDYHANRVSFKKFGELNTFGSGKIIQKKDNEVKEYFPGMVLHLDKMEIDIKTNGALGKKATFITLPILHNPKHADYEMMALAGGSRSIKVLNVVRRLVRGQYKYYLQMTIEGEKPQKGRTLGNGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISGWTTRAKETKVNEKTGKIQKKKRFGKSVANHAPSMFVSILENKVKSLGGEVVKVDTKNAASQYDFTNGSFTKHELKERNVTLSNGDTHQRDMLAAFNLQHLKYDEKDTKQYDTEAMTADYERFCQLEQEEIQRYKNKEKKDDRSTIGAEKL

SEQ ID NO: 2860 - protein, 490 aa, Unknown
  Description of Unknown: uncultivated organism sequence
  Category: MG91 effectors
  Description: MG91-51 effector
MARENENSGCFVVTFPLKTEKWQEDRIDKILTLLTVRYREKQKILLDRYIHLSHSPEFKEAKNAGLKALRDFMNEHKFTKYDVEKVFSDSSLSKSVTTDIMLTHGINSSIMQELSHRAWSAWEKKLYGQGKFIKLDNEVNIFKSRLKGSTITGFEYSFTDMTLSMNATKPKKHTMFTIPFVVNRKSEYEAYAMDCEVRNIAIMRQQIRGKNKYYVQFSFAGTPYNKGRKIGTGIVGIDPGPSKIAIVSDSEIRITTLAPSVNRDERAICRMQRKLDRSRRATNPDNYNDDGTIKRGIKLTFEKSNSYKRTQTKLADTQRKLAAKRKIDHNILANEIIAMGNEFHVENNSFKSMQARSKETKKNDKGKNMSKKRFGKSLANRAPSELLTILKNKVNQYADGDYVDIPSGVACTQFDFTNGEFTKHELKERTITTSDGVVHDRDALAAFNMRFVHKKKIEGKKKIEKDKENFDILAMTEAYRQFCSLEKNIK

SEQ ID NO: 2861 - protein, 518 aa, Unknown
  Description of Unknown: uncultivated organism sequence
  Category: MG91 effectors
  Description: MG91-52 effector
MDKEVFVIEFPLNVEKWQADILNKRYEHLRTLYNYVQGKLLRQYIYFAQMGEYKNCKTPKERREFFKTHAFHIKGISGRNNITFTEYGIHSLVTKLAQHRIGADCTYRDKGINSMILDHMAAYIWSSWNKKLYDINARRISFKNFGEINTFGVRKINGARFCGLNLHLDIMTLDIKINGKNGQQAKFISLPVRYNLKHAGYEMNALAGGFDSIKVLTVVRRMVRGRYKYYLQMTIEGVKPQKGRHLGNGRVGIDIGPTTIAVSSNSTVSIDKLAAKCDNIEQDIQRIGRKIDRSRRAMNPDNFNADGTVKRGVRLTWVKSERYKALCQEKAELQRKQAAIRKAQHIERVNTLISEGDTFIIESNPIKGWTARAKETKVSEKTGRFQKKKRWGKSVANHAPSMFVTILENKVKSLGGTVIKADVKNAASQYDFTDGTFTKHELDERGVTLSNGDTHQRDMLSAFNLQHLIYDTKELKQYDQQQMEIHYPRFCELEQQEIEKYKQRIKTDDRSTIAASRL

SEQ ID NO: 2862 - protein, 528 aa, Unknown
  Description of Unknown: uncultivated organism sequence
  Category: MG91 effectors
  Description: MG91-53 effector
MKEVFVLELPLRVEKYQADILNKRYELLRQLYNYVQGKLLRQYRYFEQMKDYQICKTFKDKREFIKAHSFHINGVLGRNKELLDISFDEYGIMGLVTKLGQKLIGSGKTYTDMGISSTILANLSDNIWSSWNKKLYDYHADRITFKKYGSLNTFGSGKIVQKKDNEVKEYFPGMVLHLERMEIEIKTNGGLGKKATFITLPILHNPKHADYEMMALAGGSSSIKVLTIVRRLVRGQYKYYLQMSIEGEKPQKGRMLGKGNVGIDLGPTTVAVSGENIACIDKLASKCDNIQAEITKLARKIDRSRRANNPQNYNEDGTIKRGIKLVWYDSKRYKELRRELAELRRKQAAIRKQQHIDRANALLKEGDTFIVENNQISGWTTRAKETKVNEKTGKIQKKKRFGKSVANHAPSMFVTILENKVKSLGGQVVKVDTQNAASQYDFTNDSFTKHELKERNVTLSNGDTHQRDMLAAFNLQHLKYDEKEKKQYDKEAMKAHYEHFCELEQEEIQRYKNKEKKDDRSTIGAEKL

SEQ ID NO: 2863 - protein, 524 aa, Unknown
  Description of Unknown: uncultivated organism sequence
  Category: MG91 effectors
  Description: MG91-54 effector
MEEVFVLELPLQVEKYQADILNKRYEQLRQLYNYVQGKLLRQYRYFEQMSEFQGCKTIREKRDFFRSHPFHIKGKLAGNKELPEITFDEYGINGFVEKLAQKSAGSNTTYADLGFTTYILDHLSTSIWAAWEKMLYDYRAKRISFKKYGELDSFSSRRKVVGGKVYFSGMELHLDTMELAIKLNAKQGKNAKFVTLRILHNPKHADYEMWALKGGLESIKVVKVVRRLVRGQYKYYLQMSIEGEKPKKGRTLGKGNVGIDLGPTTVAVSGENIASIDKLASKCDNIQEEITRLARKIDRSRRANNPQNFNEDGTIKRGVRLVWNDSKRYKALRREMAELQRRQAAIRKQQHIERANELLKEGDTFIVENNQISGWTRKAKETKVNEKTGKIQKKKRFGKSVANHAPSMFVTILENKVKSLGGEVIKVDTQNAASQYDFTNNSFEKHELKERSVTLSNGDTHQRDMLAAFNLQHLKYDKQEKKQYDTEAMAQHYERFCELEQEEIMRYKNKEKKDDRSTIGAGEL

SEQ ID NO: 2864 - protein, 609 aa, Unknown
  Description of Unknown: uncultivated organism sequence
  Category: MG91 effectors
  Description: MG91-55 effector
MAKEEFVLTLPLKVEKWQADILDKRYELLRQVYNMVQQKLVRQYIYFSQQRVYKDCKNFEQRRKFFEDHPFHIKGVKGRNGELCDIKFPYTYKSRGGSSGKRSPNGISDFVSKLWSHKIGQDKTLADFGINSSIMEELGLHIMKAWEYRLYKPKSKRVSFKEYGEINSFGSRKKNGIFGGFTLDLEKGYITYKYRKRNEKGDRTDFIQLPIDFSREKKGYPKEALKGGIDSLKKILIVRRCIRGGNKYYLQLTISGEKPQKGRTLGRGNVGIDIGPSTIATSSLKGVHFDKLADRCDNIEHELYLINRKLDRSRKANNPQNYNEDGTIKRGVRLVWKKDKDVKRYAALKRQRKELYRRQSEIRKLQHLEMANAMLSQGDTFIVENNPIDAWVRRAKETTKTKTGKNRCKKRYGKSVANHAPSMFVSILKNKVLSLGGNFYEIDLRNAATQFDFTNGEFTKHEVGERSITLSNGQTHQRDMLSAFNLQHIVLQSKELKEYDIEQMEADYPIFCKLEAAEQERFKEARRKERDALYYVGASKKQMRRQPQEESVANCHNGGVGRKHCNTSLGNENAEITGSGLARESIERISQVPDECHHFGCDPIVLDGL

SEQ ID NO: 2865 - protein, 536 aa, Unknown
  Description of Unknown: uncultivated organism sequence
  Category: MG91 effectors
  Description: MG91-56 effector
MEKENFVVELPLKVEKWQADLLDKRYELLRGIYNYVQSKLLRQFRYFEQMSEWKKCKTKKDKQKFMETHPFTIRGFKKPIILCKMKSKDNKADVYGVTNFVEQIVKNKVSADKTYKDFGINTTNINALAQHIWSAWEKKLYGKPKIIKDKKTGESIKIPNKIHFKKSGDINTISLREKNGKFTGLDVDLEHMVLYFNTNGKIGAKSKKITLPIVFSNPTEYEMYSFKNGIESVRVVTIVRKLIRGKYKFYVQFTIEGEKPQKGRTLGKGEVGVDVGPSTIAVSSLSGVQINTLAEKCDNIEHACKLLERKMDRSKRATNPQNYNDDGTIKKIKSKKIKWNYSNRYIKTRNKKCELHRKQAAIRKLQHNIDCNELLKLGKIFIVENNPISAWQRKATETKINKKGKYQSKKRFGKSIANHAPAMFITILENKVKSLGGQLIRVDIRNAASRFDFTNSDFVEHKLNERKITLSNGNTHQRDLLAAFNLQHLRYNNENLKTYNIKDMERDYPIFCKLETIEINKFINSQKKSHKSTIGY

SEQ ID NO: 2866 - protein, 609 aa, Unknown
  Description of Unknown: uncultivated organism sequence
  Category: MG91 effectors
  Description: MG91-57 effector
MAKENFVLTLPLKVEKWQADILDKRYELLRQVYNMVRQKLLRQYIYFSQQKAYKECGKDTKKKGKFFAEHPFFIKIDGKPCEVKFPTWKKSNQTASNSIAKYVSKLSSYKLGQDKTLSDFGINSYILEELGARIMKAWEDRLYKFKAKHISKREYGDVNSFSTRIKKSDNKISYPGFTINLEEGYITYNTNGRRGGFANLIKLPIDFSREKKGYAVEALKGGLESIREISVVRKYIRGKNKYYLQLTIDGEKPQKGRTLGRGNVGIDIGPSTIATSSLMGVHFDKLADKCDDIEHELYLVNRKLDRSRRATNPQNYNTDGTFKTIKNRERRVWNYSNRYNKLKLVRKELFRRQAEIRKQQHLAMANALLSQGDTFIVENNPIDAWVRRAKETSKNKKGNYRCKKRYGKSVAHHAPAMFVSILENKVKSLGGELHKVDVGYAATQFDFTNGEFTKHAVNERSITLSNGHTHQRDMLSAFNLQHARLKTDSRNIEKTVDNYDIEQMNADYPIFCRLETAEQERFKAIRHYERDALFFVGVSNKHLRCQPQEETVANRHNGGVGRKDCNISLGSENAEITGNGLIRESIARVSQVPDECHPFAGKPIVLDGL

SEQ ID NO: 2867 - protein, 484 aa, Unknown
  Description of Unknown: uncultivated organism sequence
  Category: MG91 effectors
  Description: MG91-58 effector
MAHKENQKAFVITFPLRTEKWQEDRIDKMMRMLTTFYNDRQRKLVRRYIYLSHSKAYQEAKGKGVVAFKNYMKENGFSQYGLDAFFKADTKGALYQCGLNSMFLQYLSQCAWSAWDKKLFGKGDFVKTDKVVNIFCSRNMKGRFCGFDYDLSTFTIRIKSTCTKEIICTIPFVVNKNSEYELYALSQKICRIGIVRKLIRSKYKYYVQFTFDGVPYNKGRNIGTGIVGIDPGPSKIAIVSDKKVEIAKLAPNIIEDERKTARLKRKLDRSRRATNPHMYKEDGTIIKGQRQTCFSKAYNKTRKQLAEAQRKLAAKRKIAHNELANTLLEYGDTFKVEANSYKSMQARTKATSMTKSGRIRSKKRYGKSIKNRAPSEFLVILKNKLLYYPKGKYYDVPSSYACTQFDFTNESFTEHKISERRIVTSDGIQHNRDTLAAFNIKNAIVNDASTKKKKVTKSKEFFDIVKMKASYNEFCVMESYLLSV

SEQ ID NO: 2868 - protein, 484 aa, Unknown
  Description of Unknown: uncultivated organism sequence
  Category: MG91 effectors
  Description: MG91-59 effector
MAHKENQKAFVVTFPLRTEKWQEDRIDKMMRMLTTFYNDRQRKLVRRYIYLSHSKAYKEAKSKGVVAFKNYMKENGFSQYGLDAFFKADTRGALYQCGLNSMFLQYLSQCAWSAWDKKLFRKGDFVKTDKVVNIFCSRNKKERFCGFNYDLGTFTISIKSTCTKKIICTIPFVVNKKSDYELFALSQRICRIGIVRKLIRGKYKYYVQFTFDGVPYNKGRNIGTGIVGIDPGPSKIAIVGDNKVEIAKLAPGIEEDERKTARLKRKLDRSRRATNPHMYKEDGTNIIGQRQIFFSKSYNETRKQLAEAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSTKKKKITKSNEFFDIVRMKASYNEFCLMERYLLSI

SEQ ID NO: 2869 - protein, 621 aa, Unknown
  Description of Unknown: uncultivated organism sequence
  Category: MG91 effectors
  Description: MG91-60 effector
MRLFDYICIILLMIQSMIEEFVLTLPLKVEPWQADILNNRYEHLRRIYNMVQRKLLRHYIYLSQQNKYRQCKDNDEKRTFWETHHVTIKDFCDKKGNPAILRFPHTYYTRSKASGKRTSHGIPDLLPKLKNRNIGSGLTYASLGINAAILENLGLRIEQAWKKRLYDHKSKHISFKEEGDLNTFGCREKDGFSGFVLDLQKMKLSFNTNGRQGKSAKFIHFPINAGKELTEYEMYALKGGIGSVRKIIVAREYVRGRYKYYVQLTIKGEKPQKNRTLGKGTVGIDVGPSTVAVSSLHGVSLDKLADKCDNIEHDLWRINRKMDRSKRDTNPDFFNEDKTYKKPEKGERRKWTFSNRYKRLKLKRRELYRKQAAIRKRQHIEMANALLSQGDEFIVENNPIDSWTKRAKETKRGKNGKIRCKRRFGKSVAHHAPAMFVSILQNKVRSLGGTFHKVEIKNAATQFDFTNGEFTKHELNERTVTLSNGRTHQRDMLSAFNLQHLRTNSEELKDYDIEQMEADYPVFCKLEEKGIAQFKEKRQQERDVAYFTGVSHKTLKFSSANRHNGGVGRGNCNYHAGSKRNVAKTGNKSSSKENCESMETVSLVPNEYHHSNHQPFRLDGL

SEQ ID NO: 2870 - protein, 517 aa, Unknown
  Description of Unknown: uncultivated organism sequence
  Category: MG91 effectors
  Description: MG91-61 effector
MKKKSTEETFIMELPLKVEKFQADELNKRFELMRRIYNSAQNKLERQHEYLLSFKEYKECNTKKAKGEFINNHPFSFKGVLNKNGEPMNITFTEFGLKSYLADFAKKKVDSQYTYSDFGINTSMLMSMGMAAWSAWKKVIYDPKAKDIHYKKYGDLKSIAVDWEPKHQAGMYLDVCKGVLKLNINGRRGQYAKYLTFPIKFGRKERQLWYEGDALKGGEDSFKGLAIVRRKYNGQFRYFLQLTIRNCTPTKDRTLGKGRVAIDLGIYKIAVYTGDQVYFFPLAPNCREIDEKIAVLQRQMERSKRISNPQFYNADGTYIKAKKHEHRKWNFTKEYLKLRAMKAELQRKQAAIRKQDHIDLANHLLSFGNEFVIEDNDVKAWAERKKEEKKREKDGKNLSKKGLGKPIGSHAPAAFVTLLANKVKALRGTFTKVAVDNGATDYDFINDTFTPHELKERYITLCNGVTHQRDSLAAFNLYYIDTNPEKSRCYDRKAMKRGYKKFQELEKEALKQWKKPV

SEQ ID NO: 2871 - protein, 528 aa, Unknown
  Description of Unknown: uncultivated organism sequence
  Category: MG91 effectors
  Description: MG91-62 effector
MNEVFVLELPLQIEKYQADALNKRYEQLRQLYNYVQGKLLRQHRYFEQMKEYQACKKIKEKRIFFRSHPFQINETLKGNKIPFKVSFDEYSIKGYIEKLVQKSVGPNMTYADLGFTTNILDHLGASVWAAWDKKLYDLKAKRISFKKYGELDSFSSRRKVVRGVVYFSGMELHLDSMELAIKMNGKVGKDAKFITLKMLHNPKHADYELWALKGGVDSVKVVKVVRRLVRSQYKYYVQLTIEGEKPQKGRTLGKGNVGIDLGPTTVAVSGVNVVSIDKLASKCDNIQEEITQLSRKIDRSRRANNPQNFNEDGTIKRGIKLVWSDSKRYKELRRELAELRRKQAVIRKQQHIERANALLKEGDTFIVENNPISSWTTRAKETKVNEKTGKIQKKKRFGKSVANHAPSMFVSILENKVKSLGGRFERVSTQNAASQYDFTTDTFKTGEEKHKLNERAITLSNGDTHQRDMLAAFNLQHLKYDEKDAKQYDTEAMTADYERFCQLEQEEILRYKNKVKKDDRSTIGAEKL

SEQ ID NO: 2872 - protein, 322 aa, Unknown
  Description of Unknown: uncultivated organism sequence
  Category: MG91 effectors
  Description: MG91-63 effector
MKEVFVLELPLQVEKYQADILNKRYEQLRQLYNYVQGKLLRQYRYFEQMDEFQACKTFKEKKDFFRIHPFHIDGILNNNKELLDITFDEYGVKGFVEKLVQKPVGPNMTYADLGFTTYILDHLSSSIWSAWDRMLYDYKAKRISFKRYGELDSFSSRRKVVRGKIYFSGLELHLDSMELSIKLNGKSGKDSKFITLPILHNPKHANYELWALKGGLESIKVVKIIRRMVRSCYKYYVQLTIEGEKPQKGRIIGKGRVGIDLGPTTVAISGENVVSIDKLASQCDNIQEEITRLSRKIDRSRRANNPDNYNEDGTIKRGVKLV

SEQ ID NO: 2873 - protein, 610 aa, Unknown
  Description of Unknown: uncultivated organism sequence
  Category: MG91 effectors
  Description: MG91-64 effector
MIIFTKISEFIISYWMPVKKDDKPRFVLEMPLKVEQWQADILNVRYELMRRMYNRARRILLSHFYYMVQKDEYQECASNKRERAVYIKNHPIFIKGVTDKKGNVKPITFTEFGIKDVVLSFVTRDVGSGKTYKDFGINTSFADCVASNLWAAWEKFMYDGKCKGVAFKRRFNTISIGKNNGCFGGLKLSLESMTLSVNVNGKQKGNAKFITLPVCGDNQSEYEMQALQGGLESICVVSIARKLIRGKYKYYLQLTIKGHAPNKGRALGCGTVGVDVGPSTVAFVSQSDVQINRLASECDDIEDVIGKIQQKMDRSRRATNPQNFNEDGTLKRISRKNGERRIWNDSRRYRLLCKQKAELQRKQAAVRKMSHILKINQILSLGDTFFVENNPISQWTKRAKETKVSEKTGRYCSKKRAGKSVANHAPAMFVTLLKNKVQSLGGRCREVDIKNAASRFDFTDGQFKVHGLDERIVTLSNNKTHQRDILAAFNLQHIICVDDDKKLKKYDIARMYADYPAFCDMERAEIEKFVSGEKETDRHTIGAIEELKVVLSSHADDPSVLYSVDKLSANSEGNKTGKKAGSALVHESNDRVLEVLNESTLFTIKDLHVT

SEQ ID NO: 2874 - protein, 597 aa, Unknown
  Description of Unknown: uncultivated organism sequence
  Category: MG91 effectors
  Description: MG91-65 effector
MKAIDRSFTPAVGSSPGDGHPEMKAIDRVPPVCRNSPTGDGHPEMKAIDRLATRAEKLMSGDGHPEMKAIKTMNEVFVLELPLQVEKYQEDILDKRYEQLRQLYNYVQGKLLRQYRYFEQMKEFQACKTFKEKRDFFRAHPFHINGVYGNNNELFDITFDEYGVNGFVSKMAKKQVGANMTYADLGITTTLLDRLSLAIWASWEKMLYDYHARRISFKKHGELNIFGSRKKTNGSGKKVFSGMELNLERMEVSIKLNGKVGKKAKYIILPILHNPKHVDYEMMALKGGYDSVKVITVVRRLIRGRYKYYLQMSIEGEKPKKGRTLGKGNVGIDIGPTTVAVSGENIAYIDKLASKCDSIEAEKAKLGRKIDRSRRANNPQNFNENGTIKRGVRLVWTDSKRYKALRREMTELQRRQAAIRKQQHIDRANELLKEGDTFIVENNQVSGWTRKAKETKVNEKTGKILKKKRYGKSVANHAPSMFVTILENKVKSLGGQVVKVDIQNSASQYDFTNDTFKKHELKERSVTLSNGNTHQRDMLAAFNLQHLKYDAPEKKQYNREKMALHYDHFCKLEQEEILRYKNKEKKDDRSTIGAEKL

SEQ ID NO: 2875 - protein, 524 aa, Unknown
  Description of Unknown: uncultivated organism sequence
  Category: MG91 effectors
  Description: MG91-66 effector
MNEVFVLELPLLVERYQADILNKRYEQLRQLYNYVQGKLLRQYRYFEQMKEYKACEKIKEKRDFFRAHPFHINGVLNGNKKQLDITFDKNGINGFVEKLAQKSAGPTITYADLGFTTYILDHLSASIWAAWEKKLYDFKAKRISFKKYGELDSFSSRRKVVGGKVYFSGMELHLDTMKLSIKMNGKQGDNAKFITLKMLHNPKHADYEMWALKGGVDSVKVVKVVRRLVRSQYKYYVQLTIEGEKPQKGRKLGNGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIERANALLKEGDTFIVENNQISGWTTRAKETKVNEKTGKIQKKKRFGKSVANHAPSMFVSILENKVKSLGGEVVKVDTKNAASQYDFTDNSFTKHELKERNVTLSNGDTHQRDMLAAFNLQHLKYDEAEAKQYDTEAMAANYERFCQLEQEEIQRYKNKEKKDDRSTIGAEEL

SEQ ID NO: 2876 - protein, 605 aa, Unknown
  Description of Unknown: uncultivated organism sequence
  Category: MG91 effectors
  Description: MG91-67 effector
MIEEFVLTLPLKVESWQADILNKRYEHLRRIYNTVQRRLLRNYIYLSQQKVYRQLKDNDEKRAFWEHHPITFKDFCDRNGNPAIVKFPYTYSRRSKNSGKKASNGISDFVPKFKNRNIGSGLTYGSLGINASILEELGLRIQQAWEKRIYDSKSKRISFKEEGDLNTFGCRNKKGFSGFVLDLTHMMLSLNINGRQHQLAQYIHIPINPNKEFTEYEMYALKDGLSSVRKIIVSRVYIRGRYKYYVQLTIKGEKPQKNRTLGKGSVGIDVGPSTVAISSLKGVTLDKLADKCDDIEHDLWRINRKMDRSKRATNPDFFNKDGTYIKRKKGERRKWHFSNRYNRLKLERLELYRKQATIRKQQHIDIANALLSQGDDFIVENNPIDSWAKRAKETKRGKNGKIRCKRRFGKSVAHHAPAMFVSILQNKVHSLGGSFRKVEIKNAATQFDFTNGEFTKHELNERTVTLSDGRTHQRDMLSAFNLQHLRPESEEIKDYDIEQMEVDYPIFCKLEEQGIAIFKEKRPQDRDVAYFVGTSHKTLKISSANRHNGGVGRKNCNHHAGKRKNVAKAVTKSSSKKNCESLESVSIVPNEYHHSDNQHLRLDRL

SEQ ID NO: 2877 - protein, 614 aa, Unknown
  Description of Unknown: uncultivated organism sequence
  Category: MG91 effectors
  Description: MG91-68 effector
MPKEEFVLTLPLRVEKRHADILDKRYELLRQMYNMVQQKLVRQYIYFSQQKAYKACENFEQKRKFFNAHPFHFKGIKRKNGELSDIKFPYTYESRSSWSGKRPSGGISDYVSKLWSHKLGADKRLVDFGLNGSIMEELGLHVMKAWYDRLYKFKTKRVSFKDYGEINSFGCRLNKGNFAGFTINLEEGFITFNTNGRQGRFADIITLPIDFSREKRGYAAEALKDGVDSLRKLVIVRRCIRGRNKYYLQLTISGEKPEKGRTLGKGNVGIDIGPSTIATSSLQGVHFDKLADKCDNIEHELYIVNRKMARSRYENNRKYYNEDRTFKPREKGEIRRWKESNRFKQLKLVRRELYRKQAEIRKQQHLEMANAMLSQGDTFIVENNPIDAWVRRAKETTKTKTGKYRSKKRYGKSVANHAPAMFVTILENKVKSLGGEFHRIDPGYAATQFDFTNGVFTKHEVSERSITLSNGRTHQRDMLSAFNLQHARLDGEKEKSRDKEKKVESYDIAQMQADYPIFCRLETVEQERFKDARRNERDALYFVGAFAKELRHEPQEETVANRHNGGVGRKHCNTLCTENAKITGGLVRESIERVSEAPEECHHVGNQPIILDGL

SEQ ID NO: 2878 - protein, 510 aa, Unknown
  Description of Unknown: uncultivated organism sequence
  Category: MG91 effectors
  Description: MG91-69 effector
MFVVELPLKVEKWQSDVLNKRYELIAKIYNYAQKKLLRQYIYLTQMDEYKKCKTKKEKSNFFKNHPFYFKDITSKITFSEYDVTAFVEKIIKKNVSSDKTYKDFGINTSITECLGKHIWSAWEKKIYDKGKKISFKNKGELNTISIRKKSEYFGGLDVDIEHMILSFNINGKIKAKAKKIILPINVKNLTEYEMYALQGGYDSINVVTIIRKTIRGKYKYYVQFTIEGEKPQKGRTLGKGNVGIDIGPSTVAISSLNGVTIDTLAEKCDNIESKISDIGRKMDRSRRATNPQNFTEDGQIKRIDRKKGEKRVWKCSKRYVKLRNKKHELLRKQAVIRKLQHNIKANEILSLGDTFIVEDNPTSAWAKRAKGVRKNKNGKIQTNKRFGKSIANHAPSMFVTILQNKVDSLKGKFVKVDCKNAASRFDFTNGDFTGHNLDERKITLSNGNTHQRDMLAAFNLQHIDLTNDDLKKYNVDEMVEDYPIFCKLEKEEIGKFINGQKKSRSCTVGY

SEQ ID NO: 2879 - protein, 413 aa, Unknown
  Description of Unknown: uncultivated organism sequence
  Category: MG91 effectors
  Description: MG91-70 effector
MKENGFSQYGLDAFFKADTKGALYQCGLNSMFLQYLSQCAWSAWDKKLFGKGDFVKTDKVVNIFCSRNMKGRFCGFDYDLSTFTIRIKSTCTKKIICTIPFVVNKNSEYELYALSQKICRIGMVRKLIRSKYKYYVQFTFDGVPYNKGRNIGTGIVGIDPGPSKIAIVSDEKVEIAKLAPGIEEDERKTARLRRKLDRSRRATNPHMYKEDGTIIKGQRQTYFSKVYNETRKQLADAQRKLAAKRKIAHNELANTLLEYGDTFKVEANSYKSMQARAKATSMTKSGRIRSKKRYGKSIKNRAPSEFLVILKNKLLHYPNGKYYAVPASYACTQFDFTNESFTEHKISERRIVTSDSIQHNRDTLAAFNIKNAIVNDTSTKKKKVTKSKEFFDIVKMKASYNEFCVMERYLLSV

SEQ ID NO: 2880 - protein, 535 aa, Unknown
  Description of Unknown: uncultivated organism sequence
  Category: MG91 effectors
  Description: MG91-71 effector
MAQETFVLELPLKVEKWQADILDKRYEYLRQIYNYVQKKLIRQYKYFEQMNEFRQCTTYREKREFFRSHPFYYNEVVGRNGEPFAIKFPYSMSESNGAKLDGFNGYISKLGKLPAGANKTYADLGINSFMLERLASNMWSAWNKFLYDRDAKRVAFKKYGELNTFGSRKKNNISFIGMTIHLDTMELVIKTNGRTGRFAEYITLPIGAGKPLTEYEMYALKGGFDSIKILNVVRKQIRGNNKYYLQMTIEGEKPQKGRTLGVGCVGIDLGPSTIAVSSLQKVSIDKLANKCDDIQRDLNRVSRKMDRSRRANNPQNFNEDGTIKPVSRKNGERRVWNDSKRYRKLREERRELLRKQAAIRKAQHIETANALLPLGDTFIVENNPVSSWTRKSKETKINKKGKIQSKKRFGKSVANHAPSMFATILQNKVESLGGEFRKVEVKNAASRFDFTNGEFTEHGLGERVIALSNGDKHQRDLLAAFNLQHLNADGDTTKDYDVATMQEDYPTFCRLEREEMDLYLQGKKKNERTTIGAFK

SEQ ID NO: 2881 - protein, 524 aa, Unknown
  Description of Unknown: uncultivated organism sequence
  Category: MG91 effectors
  Description: MG91-72 effector
MKEVFVLDLPLRVEKYQSDILNKRFEQLRQLYNYVQGKLLRQYRYFEQMKEYQACKTFKEKKDFFRNHPFHINGILGSNKELLDITFDEYGIKGFVEKLVQKGVGTDMTYADLGFTTYILDHLSAGIWSAWDKMLYDYKARRISFKKYGELDSFSSRRKVVQGKVYFSGMELHLDSMMLSVKMNGKVGKAAKFITLPILHNPKHADYEMWALKGGLDSIKVVKVVRRMVRGRYKYYLQMSIEGEKPLKGRKLGKGNVGIDLGPTTVAVSGENIASIDKLASKCDSIETEKAKLGRKIDRSRRANNPQNFNEDGTIKRGIRLEWNDSKRYKELRVEMAELQRRQAAIRKQQHIDRANELLKEGDTFIVENNQISGWTRKAKETKVNENTGKIRKKKRFGKSVANHAPAMFMTILENKVKSLGGKVVKVDTQNAASQYDFTNNSFTKHELNERSVTLSNGDTHQRDMLAAFNLQHLKYDEQEKKQYDTEAMTKHYGRFCELEQAEILRYKNKEKVDDRSTIGAKEL

SEQ ID NO: 2882 - protein, 527 aa, Unknown
  Description of Unknown: uncultivated organism sequence
  Category: MG91 effectors
  Description: MG91-73 effector
MNEVFVLELPLQVEKYQADILDKRYEQLRQLYNYVQGKLFRQYRYFEQMKEYQACEKINEKKDFFRTHPFLINETLKGIKTPFMVSFDEYSIKGFIEKLAQKQVGPNMTFADLGFTTYILDHLGASVWAAWDKKLYDFKAKRISFKKYGELDSFSSRRKVVRGVVYFSGMELHLDTMELAIKMNGKVGKEAKFITLKMLHNPKHADYEMWALKGGVEIVKVVKVVRRLVRSQYKYYVQLTIEGEKPQKGRTLGKGNVGIDLGPTTVAVCGENVVSIDKLASKCDNIQEKITRLSRKIDRSRRANNPQNFNEDGTIKRGIKLVWKKDKDLKRYSKLKRELVELRRKQTAIRKQQHIDRANALLKEGDTFIVENNQISSWTMRAKETKVNEKTGRIQKKKRFGKSVANHAPSMFINILENKVKSLGGKVVKVDTKNAASQYDFTDGSFTKHELKERNVTLSNGDTHQRDMLAAFNLQHLKYDEAEAKQYDTEAMAADYERFCQLEQEEIQRYKNKEKKDDRGTIGAEKL

SEQ ID NO: 2883 - protein, 193 aa, Unknown
  Description of Unknown: uncultivated organism sequence
  Category: MG91 effectors
  Description: MG91-74 effector
MRRELAELRRKQAAIRKLQHIERANALLKEGDTFIVENNQISSWTTRAKETKVNEKTGKIQKKKRFGKSIANHAPAMFVDILENKVKSLGGEVVKVDTKNAASQYDFTDNSFTKHELKERNVTLSNGDTHQRDMLAAFNLQHLKLDEAKTKQYDTEAMNADYDRFCQLEREEILRYKNKEKKDDKGTIGAEGL

SEQ ID NO: 2884 - protein, 538 aa, Unknown
  Description of Unknown: uncultivated organism sequence
  Category: MG91 effectors
  Description: MG91-75 effector
MMVIQKCRLFVIMKEVFVLEMPLLVEKYQEDILNKRFEQLRQLYNYVQGKLLRQYKYFEQMAEFQICKTSKAKREFIKTHPFHINGVIGRNKDLLDISFDEYGILGLVTKLGQKPLGSGKSYADMGISSTILANLSNNIWSAWNKKLYDYHAKRISFKRYGELNSFGSGKIVQKKDNDVKEYFPGFILHLERMELDIKTSKSGKNETCITLPILHNPKHADYEMWALKDGSTSIKVLTIVRRLVRGRYKYYLQMSIEGEKPQKGRTLGKGNVGIDIGPTTVAVSGENIASIDKLASKCDNIQEEITRLARKIDRSRRANNPQNFNEDGTIKRGVRLVWNDSKRYKALRKEMAELQRKQAAIRKQQHIDRANALLKEGDTFVVENNPIKGWQARAKETKIDEKTGRFKSKKGRGKSIGNHAPAMFVTILENKVKSLGGEVVKVDTHNAASQYDFTNESFTDHGYDRKITLSNGDTHQRDMLAAFNLQHLKYDETEKKQYDTEAMVQHYDRFCELEQEEILRYKNKEKKDDRSTIGAGDL

SEQ ID NO: 2885 - protein, 533 aa, Unknown
  Description of Unknown: uncultivated organism sequence
  Category: MG91 effectors
  Description: MG91-76 effector
MEEVFVLELPLRVEKYQSDILNKRYEQLRQLYNYVQGKLLRQYRYFEQMREFQDCKTFKEKRDFFRSHPFHINGIMGSNKELLDITFDEYGIQGFVSKLGKKLAGTNTSYADLGITSTILDRLSLAVWSSWEKMLYSLKTKRLAFKKYGELDSLSNRRIVAKGKVCFPGMELHLEKMELAIKLNSKTGKNAKFITLPILHNPKHADYEMWALKGGIDSIKVLTVVRRLVRGQYKYYLQMSIEGEKPQKGRTLGKGNVGIDLGPTTIAVSGENVVSIDKLASKCDNIQKEITRLARKIDRSRRANNPQNFNEDGTVKRGIKLVWNDSKRYKELRREMAELQRRQAAIRKQQHIDRANELLKEGDTFIVENNQISGWTRKAKETKVNEKTGKIQKKKRFGKSVANHAPAMFVTILENKVKSLGGEVVKVDTQNAASQYDFTNDSFEKHELKERSVTLSNGDTHQRDMLAAFNLQHLKYDDKEKKQYDTEAMKEHYERFCELEQEEIQRYKDKEKKDDRSTIGAEKLHMNDGTVKK

SEQ ID NO: 2886 - protein, 528 aa, Unknown
  Description of Unknown: uncultivated organism sequence
  Category: MG91 effectors
  Description: MG91-77 effector
MNEVFVLELPLQVEKYQADILNKRYEQLRQLYNYVQGKLLRQYKYFEQMKEYQSCRTFKEKKDFFRNHPFQIKGVLGRNKELLDIFFDEYGIFGLVTKLGQKPMGSGMSYTDMGISSTILANLSYNIWSSWNKKLYDYHADRISFKKHDGLNTFGSGKIVKKKDNEVKEYFPGMVLHLDRMEIDIKTNGGLGKKTTFIALPILYNPKHADYEMMALKGGTKSIKVLTVVRRLVRGQYKYYLQLTIEGEKPQKGRTLGKGNVGIDLGPTTVAISGKNVVSIDKLASKCDNIQEEITRLSRKIDRSRRANNPQNYNEDGTIKRGIKLVWNDSKRYKELRRELAELRRKQAAIRKQQHIDRANALLKEGDTFIVENNQISGWTTRAKETKVNENTGKIQKKKRFGKSVANHAPSMFVSILENKVKSLGGEVVKVDTKNAASQYDFTDGSFTKHELKERNVTLSNGDTHQRDMLAAFNLQHLKYDEAEAKQYDTEAMAADYERFCQLEQEEIQRYKNKEKKDDRGTIGAEKL

SEQ ID NO: 2887 - protein, 528 aa, Unknown
  Description of Unknown: uncultivated organism sequence
  Category: MG91 effectors
  Description: MG91-78 effector
MEEVFVLELPLLVEKYQADILNKRYEQLRQLYNYVQGKLLRQYRYFEQMTEFQVCKTFKEKRDFLRSHPFHINGILGSNKALLDITFDDYGINGFVTKLGLKSISNEKTYADIGINSSILAKLSNNIWSSWDKMLYDNKAKRISFKKYGEINSFGCGKKTNGSGKKVFSGMELRLEKMELAIKLNSKTGKNAKFITLPILHNPKHADYEMWALKGGYDSVKVITVVRRMVRGQYKYYLQMSIEGEKPQKGRTLGKGTVGIDIGPTTIAVSGENIVSIDKLAAKCDNIEAEIQRLARKIDRSRRANNPDNFNEDGTVKRGVRLVWKKDKDCKRYAALKREMAELHRRQAAIRKQQHIDRANELLKEGDTFIVENNQISGWVRRAKETKVSEKTGRIQKKKRFGKSVANHAPSMFVTILENKVKSLGGEVVKVDTQNAASQYDFTNNSFEKHELNERSVTLSDGKKHQRDMLAAFNLQHLKYGESEKKQYDTEAMNQHYERFCELEHEEIMRYKNKEKKDDRSTIGAGDC

SEQ ID NO: 2888 - protein, 528 aa, Unknown
  Description of Unknown: uncultivated organism sequence
  Category: MG91 effectors
  Description: MG91-79 effector
MNEVFVLELPLQIEKYQADALNKRYEQLRQLYNYVQGKLLRQYRYFEQMKEYQACKKIKEKRFFFRSHPFQINETLKGNKIPFKVSFDEYSIKGYIEKLVQKSVGPNMTYADLGFTTNILDHLGASVWAAWDKKLYDLKAKRISFKKYGELDSFSSRRKVVRGVVYFSGMELHLDSMELAIKMNGKVGKDAKFITLKMLHNPKHADYELWALKGGVDSVKVVKVVRRLVRSQYKYYVQLTIEGEKPQKGRTLGKGNVGIDLGPTTVAVSGVNVVSIDKLASKCDNIQEEITQLSRKIDRSRRANNPQNFNEDGTIKRGIKLVWSDSKRYKELRRELAELRRKQAVIRKQQHIERANALLKEGDTFIVENNPISSWTTRAKETKVNEKTGKIQKKKRFGKSVANHAPSMFVSILENKVKSLGGRFERVSTQNAASQYDFTTDTFKTGEEKHKLNERAITLSNGDTHQRDMLAAFNLQHLKYDEKDAKQYDTEAMAADYERFCQLEQEEILRYKNKVKKDDRGTIGAEKL

SEQ ID NO: 2889 - protein, 521 aa, Unknown
  Description of Unknown: uncultivated organism sequence
  Category: MG91 effectors
  Description: MG91-80 effector
MNEVFVLELPLQVEKYQADILNKRYEQLRQLYNYVQGKLLRQYKYFEQMKEYQACKAFKEKKDFFRSHPFQINETLKGNETALKVSFDEYSIKGYIEKLVQKSVGQNMNYADLGFTTNILDHLGASIWAAWDKKLYDFKAKRISFKKYGELDSFSSRRKVVGGKVYFSGMELYLDTMELAIKMNGKVGKEAKFITLKMLHNPKHADYEMWALKGGVESVKVVKVVRRLVRSQYKYYVQLTIEGEKPQKGRTLGKGNVGIDLGPTTVAVSGENIVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISGWTTRAKETKVSEKTGKIQKKKRFGKSVANHAPSMFVSILENKVNSLGGQVVKVDTQNAASQYDFTDGSFTKHELKERNVTLSNGDVHQRDMLAAFNLQHLTGEKRQYDVEAMKRDYERFCQLEQEEIQRYKNKEKKDDRGTIGAEKL

SEQ ID NO: 2890 - protein, 605 aa, Unknown
  Description of Unknown: uncultivated organism sequence
  Category: MG91 effectors
  Description: MG91-81 effector
MVEEFVLTLPLKVEPWQADILNNRYEHLRRMYNMVQRKLLRHYIYLSQQKAYRQCKDNDEKRTFWENQPITFKDLCDKNGNPAIVRFPHTYYTRSKASGKRTSNGIPDLLPKFKNRNIGSGLTYASLGINAAILENLGLRIEQAWKKRLYDPKSKHISFKDEGDLNTFGCREKDGFSGFVLDLPRMMLSFNINGKQKSQAKFIHLPINAGKELTEYEMYALKGGLDSIRKIIIAREYVRGRYKYYVQLTIKGEKPQKNRTLGNGSVGIDVGPSTVAISSLQGVTLDKLADKCDDIEHDLWRINRKMDRSKRKTNPDFFNDDKTYKKRKRGERRIWHFSKRYKRLKLERRELYRKQAAIRKQQHIDMANALLSQGDEFIVENNPIDSWAKCAKETKKNKNGKNRCKRRFGKSIAHHAPAMFISILHNKVRSLGGSFSKVEIKNAATQFDFTNGEFTKHELNERIVTLSDGRTHQRDMLSAFNLQHLRPESEEIKDYDIEQMEVDYPIFCKLEEQGIAIFKEKRPQDRDVAYFVGTSHKTLKISSANRHNGGVGRKNCNHHAGKRKNVAKAVTKSSSKKNCESLESVSVVPNEYHHSDNQHLRLDRL

SEQ ID NO: 2891 - protein, 525 aa, Unknown
  Description of Unknown: uncultivated organism sequence
  Category: MG91 effectors
  Description: MG91-82 effector
MNNETFIMELPLIVEKFQSDELDKRFEILRRIYNMAQNKLERQFCYLSKFKEYQECTTKKAKGEFIKKHPFSFKDILDKSGNPLMITFTKYDIQGYLSKFAKLKIDSQYTYSDMGINTSMLMHMGMAIWSAWEKVIFDSKADKISYKKYGDLKSIGVDWEPKHPAGFILNLQKGELKLNLNNRQGQYARYITMKIRFGRKEHQVWYEGDALNAGEDSIRVLTIVRRKIRGRYNYYLQMTIRNNKPQKGRTLGEGRVAIDLGTSKIAVVAKDKVHLLPLSPSILSVSDELRIIQRQMDRSRRANNPQKYHEDGTVKKGNHDKWVNSKEYIRLRNMKAELERKQAAVRKQDHIALANYLLSLGNEFVIEDNDVQEWAKRKKEEKRRKSDGKNLSKAGLGKQIGNHAPSMFVTILKNKVESLGGTFVKVDNNNRATDYDFTNNTFNEHKLEERYITLGNGNRHQRDTLAAFNLYHLDTAPEKEKCYNLYEMRKHYAQFCEFEKEALLRWKGMTPKREKMKVREHERGL

SEQ ID NO: 2892 - protein, 490 aa, Unknown
  Description of Unknown: uncultivated organism sequence
  Category: MG91 effectors
  Description: MG91-83 effector
MARENENSGCFVVTFPLKTEKWQEDRIDKILTLLTVRYREKQKILLDRYIHLSHSPEFKEAKKTGLKAFRDFMNEHNFTKYDVEKVFSDSSLSKSVTADIMLTYGINSDIMQELSHRAWSAWEKKLYGQGKFIRLDNEVTLFKSRSHKGNVTGFEYSFTEMTLSMNATKPKKHTMFTIPFVVNRKSEYEAYALGCEVKNIAIMRQQIRGKNKYYVQFSFAGTPYNKGRKMGTGIVGIDPGPSKIAIVSDSEIRITTLAPSVTKDEKAVCRLQRKLDRSRRATNPDNYNDDGTIKRGIKLKFEKSNSYKRTQTKLADMQRKLAAKRKIDHNILANEIITMGNEFRVEKNSFKSMQVRSKETKKNDKGKNLSKKRWGDSLSNHAPAELLTILKNKVCQYADGEYVDIPSSVACTAFDFTNGEFTKHPPKERTITTSDGFVHDRDALAAFNMRFVHKKKIEGKKKIEKDKENFDILAMTEAYRQFCSLEKNIK

SEQ ID NO: 2893 - protein, 528 aa, Unknown
  Description of Unknown: uncultivated organism sequence
  Category: MG91 effectors
  Description: MG91-84 effector
MEEVFVLELPLQVEKYQADILNKRYEQLRQLYNYVQGKLLRQYRYFEQMTEFQVCKTFKEKRDFFRSHPFHINGILGSNKELLDITFDDYGINGFVTKLGLKSIGNGKTYTDIGINSAILEKLSDNIWASWDKMLYDYKAKRISFKRYGELNSFGCRKKLNGSRKKVFSGMELRLDKMELAIKLNSKTGKNAKFITLPILHNPKHADYEMWALKGGYDSVKVITVVRRMVRGQYKYYLQMSIEGEKPQKGRTLGKGTVGIDIGPTTIAVSGENIVSIDKLAAKCDNIEAEIQRLARKIDRSRRANNPDNFNEDGTVKRGVRLVWKKDKDCKRYAALKREMAELHRRQAAIRKQQHIDRANELLKEGDTFIVENNQISSWVRRAKETKVSEKTGRIQKKKRFGKSVANHAPSMFVTILENKVKSLGGEVVKVDTQNAASQYDFTNNSFEKHELNERSVTLSDGKKHQRDMLAAFNLQHLKYGESEKKRYDTEAMNQHYERFCELEHEEIMRYKNKEKKDDRSTIGAGDL

SEQ ID NO: 2894 - protein, 524 aa, Unknown
  Description of Unknown: uncultivated organism sequence
  Category: MG91 effectors
  Description: MG91-85 effector
MKEVFVLELPLRVEKFQEDILNKRYEQLRQLYNYVQGKLLRQYRYFEQMKEFQACTTLKDKRDFIRTHPFHIYGVYGKNGDLFDITFDEYGINGFVAKLGKKLVGTNTTYADLGITSTILDRLSLAIWASWEKMLYSFHTKRLSFKKYGELDSLSNRRIVVRGKVCFPGMELHLEKMELAIKLNSKTGKNAKFITLPILHNPKHADYEMWALKGGIDSIKVITVVRRLVRGQYKYYLQMSIEGEKPQKGRTLGKGNVGIDIGPTTVAVSGENIASIDKLASKCDNIQEEITRLARKIDRSRRANNPENFNEDGTIKRGVRLVWNDSKRYKALRKEMAELQRRQAAIRKQQHIDRANELLKEGDTFIVENNQISGWTRKAKETKVNEKTGKIQKKKRFGKSVANHAPSMFVTILENKVKSLGGEVIKVDTQNAASQYDFTNNSFEKHELKERSVTLSNGDTHQRDMLAAFNLQHLKYDAQEKKQYDTEAMAQHYERFCELEQAEIMRYKNKEKKDDRSTIGAGDL

SEQ ID NO: 2895 - protein, 524 aa, Unknown
  Description of Unknown: uncultivated organism sequence
  Category: MG91 effectors
  Description: MG91-86 effector
MNDVFVLELPLQVEKYQADILNKRYEQLRQLYNYVQGKLLRQYRYFEQMKEYQACKTIKEKRDFFKSHPFQVNESLGGDKSAFEISFNEFSIKGFIEKLVQKSVGANMTYADLGFTTNILDHLGASVWAAWDKKLYDFKAKRISFKKYGELDSFSSRRKVVGGKVYFSGMELHLDTMELAIKMNGKQGNNAKFITLKMQHNPKHAEYEMWALKGGVDSVKVVKVVRRLVRSQYKYYVQLTIEGEKPQKGRTLGMGNVGIDLGPTTVAVSGENVVSIDKLASKCDNIQEGITRLSRKIDRSRRANNPQNFNEDGTIKRGIKLVWNDSKRYKELRRELAELRRKQAAIRKQQHIERANALLKEGDTFIVENNQISGWTTRAKETKVNEKTGKIQKKKRFGKSVANHAPSMFVSILENKVKSLGGEVVKVDTKNAASQYDFTDNSFTKHELKERNVTLSNGDTHQRDMLAAFNLQHLKYDEKENKQYDKEGMKAHYERFCKLEQEEIQRYKNKEKKDDRGTIGAKKL

SEQ ID NO: 2896 - protein, 490 aa, Unknown
  Description of Unknown: uncultivated organism sequence
  Category: MG91 effectors
  Description: MG91-87 effector
MARENENSGCFVVTFPLKTEKWQEDRIDKILTLLTVRYREKQKILLDRYIHLSHSPEFKEAKNAGLKALRDFMNEHKFTKYDVEKVFSDSSLSKSVTTDIMLTYGINSDIMQELSHRAWSAWEKKLYGQGKFIRLDNEVTLFKSRSHKGNVTGFEYSFTEMTLSMNATKPKKHTMFTIPFVVNRKSEYEAYAMDCEVRNIAIMRQQIRGKNKYYVQFSFAGTPYNKGRKIGTGIVGIDPGPSKIAIVSDSEIRITTLAPSVNRDERAICRMQRKLDRSRRATNPDNYNDDGTIKRGIKLTFEKSNSYKRTQAKLADTQRKLAAKRKIDHNILANEIIAMGNEFHVENNSFKSMQARSKETKKNDKGKNMSKKRFGKSLANRAPSELLTILKNKVNQYADGDYVDIPSGVACTQFDFTNGEFTKHELKERTITTSDGVVHDRDALAAFNMRFVHKKKVEGKKKIEKDKENFDILAMTEAYRQFCSLEKNIK

SEQ ID NO: 2897 - protein, 527 aa, Unknown
  Description of Unknown: uncultivated organism sequence
  Category: MG91 effectors
  Description: MG91-88 effector
MNEVFVLELPLQVEKYQEDILERRFEQLRQLYNYVQGKLLRQYRYFEQTKEFQACKTIKEKRDFFRNHPFHFNGIYGNNNELFNITFDEYGVNGFVSKMAKKQVGANMTYADLGITTTLLDRLSLAIWASWEKKLYDYHTKRISFKKHGELNIFGSRKKTNGSGKKMFSGMELNLERMEVSIKLNGKVGKKAKYITLPILHNPKHVDYEMLALKGGFDSVKVITVVRRLVRGRYKYYLQMSIEGEKPKKDRTLGKGNVGIDIGPTTVAVSGENIASIDKLASKCDSIEVEKARLGRKIDRSRRANNPQNFNEDGTIKRGVRLVWNDSKRYKVLRREMTELQRRQAAIRKQQHIDRANELLKEGDTFIVENNQISGWTRKAKETKVNEKTGKIQKKKRFGKSVANHAPSMFVTILENKVKSLGGQVVKVDTKNAASQYDFTNDSFEKHELNERSVTLSNGDTHQRDMLAAFNLQHLKYDAQEKKQYDREAMTQHYDRFCKLERAEIMRYKNKEKRDDRSTIGAGELNT

SEQ ID NO: 2898 - protein, 528 aa, Unknown
  Description of Unknown: uncultivated organism sequence
  Category: MG91 effectors
  Description: MG91-89 effector
MNEVFVLELPLKVEKYQADILNKRYEQLRQLYNYVQGKLLRQYRYFEQMKEFQECKSFKSKREFIKAHPFQIKGVMARNKELLDIFFDEYGILGLVTKLGQKPIGSGKTYTDMGISSTILANLSDNIWSSWNKKMYDYHADRISFKKFGELNTFGSGKIVQKKDNEVKEYFPGMVLHLDKMEIDIKTNGALGKKATFITLPILHNPKHVDYEMMALAGGSRSIKVLTIVRRMVRGQYKYYVQLTIEGGKPQKGRTLGKGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISGWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYDEKDTKQYDTESMAADYERFCQLEQEEIQRYKNKEKKDDRSTIGAEKL

SEQ ID NO: 2899 - protein, 579 aa, Unknown
  Description of Unknown: uncultivated organism sequence
  Category: MG91 effectors
  Description: MG91-90 effector
MIEEFVLTLPLKVEKWQADILNNRYEHLRHIYNMVQRKLLRQYIYYSQQTEYRNCKSNDERREFWGNHPFTIKGICDQKGNSPIVKFPYTYSSRSKGSGKRASNGISDLLPKLKHYNIGSGKTYGSLGLNASILENLGLSIQQAWEKRLYDKKSRHISFKKEDELNTFGCRFKRGFSGINLDLSKMILSLNINGRQHNLAKYINLSINPNKKFTEYEEYALKGGISSIKKIVILREYIRGRYKYYVQLTIEGEKPQKNRTLGVGTVGIDVGPSTVAVSSLYCVSFNKLADKCDDIEHDLWLVNRKMDRSKRATNPGFFAADGTYIKRKKGERRKWKFSHRYENLRSVRRELYRKQAVVRKQQHIAMANEMLSQGDTFIVENNPVDSWTRRAKETKKNKKGKMRCKRRFGKSVVHHAPAMFVSILENKVRSLGGTFHKADIKNAATQFDFTNGELKKHELKERTVTLSNGKTHQRDMLAAFNLQHLRVDSTKDKDYDVEQMILDYPVFCKLEEQETTSFIEAKGKDKDAAYFAGISSKETNRSSNRHNGGVERKHCNNHEEKGDAAKSGKKNFQEGFPRA

SEQ ID NO: 2900 - protein, 849 aa, Unknown
  Description of Unknown: uncultivated organism sequence
  Category: MG91 effectors
  Description: MG91-91 effector
MKEEDIIKFSDSLKGLGTNKKGVALILRNPIKITEDSAVQGVIIDNKPDRKEGIDRLDYIVYDRENGMHRSPATEGNFDQEVPYHILSRFEDLMDCGKLIPVVFEDSVNPFSTDITFKHNDPLKNDKKAFWNYPLDKEQFEASSSVRFYKSVLAPRNFSESNTFNCKTEEASLYFAVENARRLSKRGSAVRDFRNKDIWTVSLDNADESKPLDVETAEFFATKSIRSSILNMGDTKVFQALFDSKKNAIAFASDYANWMTKAEIAVGKLLGFNIPSNIQDQGMDLLGGDKKYIDCYLQKNFYTEEFQERPFGELLDNTLKWIREYGANPDEENIKAVSESLDKIAFDKYVVEGIHLDYFFQEPITLDDGRKIVGFGKNLGKDNVTWAAKAYTTNADNTAVEKVDFKDLPHDGLKKAIEKLDSPYHPHIDFGDKKLNVYKMDRVAYSLYQRISNVGAKSFTPSEASQAELFFKQLPEEIRQPMAVYLENLVRKNINEKEVSLPEKWFTSAFEELEKIAKDGLPIKYNLKHADYEMTALAGGIDSIKLLTVVRRLVRGKYKYYLQITIKGKKPQKGRELGSGKVGIDLGASTIAVCGDNIVSIDKLAAKCDYIQKDVKKIQRKMDRSRRANNPDNYNENGAIKKGKKLVWKNSNRYKALCKQYAEIKRKQAAVRKIEHIERANNLLKEGNIFITEKNPIKEWAKKSEETEINPKTGKTKSKKKYGKSISVHAPGMFIEILKNKVVSLGGKFIKDNPENAASEYDFTNDTFTDHGFDRTITLSNGDKHQRDTLAAFNIKNRKYDEEEPKQYNREQMQKEYARFCELEREEIEKYKNGTKKDYRRTIAAYKLY

SEQ ID NO: 2901 - protein, 607 aa, Unknown
  Description of Unknown: uncultivated organism sequence
  Category: MG91 effectors
  Description: MG91-92 effector
MAKEEFVLTLPLKVEKWQADILDKRYELLRQVYNMVQQKLVRQYIYFSQQKAYRDCKNFEQRRGFFEAHPFHVKSVKGKNGELCDIKFPYTYKSRGGSSGKRAPNGISDYVSKLWSHKIGQNKTLADFGINSYIMEELGLHIMKAWEDRLYKPKSKRVSFKDYGEINSFGSRNKNGNFAGFTINLDNGIITYKTNGRQGQFADLIQLPIDFSREKNGYASEALKGGIESLKKLLIVRRCIRGENKYYLQLTISGEKPQKGRTLGKGNVGIDIGPSTIATSSLNGVYFDKLADKCDNIEHELYLINRKLDRSRRANNPQNYNEDGQIKRGVRLVWKKDKDVKRYATLKLQRKELYRKQAEIRKLQHLEMANAMLSEGDTFIVENNPIDAWVRRTKETTKTKAGKNRCKKRYGKSVANHAPAMFVSILKNKVLSLGGKFYEIDPRNAATQFDFSNGEFTKHEVSERSITLSNGRTHQRDMLSAFNLQHIVLQNKELKEYDIEQMEADYPIFCRLENTELERFKEARHKERDALYFAGASEKQMRRQPQEESVANRHNGGVGRKHCNTSLGGGNAKITGNGLARESIERVSQVPDERHLSGCVPISLDGL

SEQ ID NO: 2902 - protein, 524 aa, Unknown
  Description of Unknown: uncultivated organism sequence
  Category: MG91 effectors
  Description: MG91-93 effector
MKEVFVLELPLQVEKYQADILNKRYEQLRQLHNYVQGKLLRQYRYFEQMKEFQACKTFKEKKDFFRNHPFHVNGIWGSNKELLDITFDEYGINGFVEKLVQKSVGSDMTYADLGFTTNILDHLSASIWRAWDKMLYDYHAKRVSFKKYGELDSFSSRRKVVGGKVYFSGMELHLDTMVLSIKLNGKQGKSAKFLTLPILHNPKHADYEIWALKGGLDSVKVVKVVRRMVRGNYKYYLQMSIEGEKPQKGRTLGKGNVGIDLGPTTVAVSGNNVVSIDKLAAKCDNIQAEIARLGRKIDRSRRANNPHNFNEDGTIKRGVRLVWNDSKRYKALRRDMAELQRRQAAIRKQQHIDRANALLKEGDTFIVENNQISGWTRKAKETKVNEKTGKIQKKKRFGKSVANHAPAMFVTVLENKVNSLGGKVVKVDTKNAASQYDFTNGSFEKHELKERNVTLSNGDTHQRDILAAFNLQHLKYDEKEKKQYDVESMKAHYERFCYLEQAEIMRYKNKEKKDDRSTIGAEKL

SEQ ID NO: 2903 - protein, 515 aa, Unknown
  Description of Unknown: uncultivated organism sequence
  Category: MG91 effectors
  Description: MG91-94 effector
MELPLQVEKYQEDILNKRYEQLRQLYNYAQGKLLRQFRYFEQMKDYQLCKTFKEKKDFFKNHPFQINGILGSNKQPLDITFDEYGINGFVEKLVQKSAGPNITYADLGITTTILDHLSSSIWRAWDKMLYDYHAKRVSFKKYGELDSFSSRRKVVGGKVYFSGLELHLDTMKLSVKLNGKQGSNAKFITMPILYNPKHEDYELWALKGGLESVKVVKVIRRLVRSQYKYYVQLTIEGEKPQKGRTLGKGNVGIDLGPTTVAVSGENIASIDKLASKCDNIQKEITRLARKIDRSRRANNPENFNEDGTIKRGVRLVWNDSKRYKALRKEMAELQRRQAAIRKQQHIDRANALLKEGDTFIVENNQISAWVRKAKETKVNEKTGKIQKKKRFGKSVANHAPAMFVTILENKVKSLGGEVVKVDTQNAASQYDFTNDSFEKHELNERSVTLSNGDTHQRDMLAAFNLQHLTAEKKQYDREAMAQHYDRFCELEQTEIERYKNKEKKDDRSTIGAGGL

SEQ ID NO: 2904 - protein, 413 aa, Unknown
  Description of Unknown: uncultivated organism sequence
  Category: MG91 effectors
  Description: MG91-95 effector
MKENGFSQYGLDAFFKADTKGALYQCGVNSMFLQYLSQCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSTKKKKITKSNEFFDIVRMKASYNEFCLMERYLLSI

SEQ ID NO: 2905 - protein, 527 aa, Unknown
  Description of Unknown: uncultivated organism sequence
  Category: MG91 effectors
  Description: MG91-96 effector
MNEVFVLELPLQVEKYQADILNKRYEQLRQLYNYVQCKLLRQYRYFEQMNEYQACEKIKEKRDFFRAHPFQINEKLKGKNTPITVSFDEYSIKGFIEKLAQKQVGPNKTYADLGFTTYILDHLGASVWAAWDKKLYDFKAKRISFKKYSELDSFSSRRKVVRGVVYFSGMELHLDTMELAIKMNGKVGKDAKFITLTMLHNPKHADYEMWALKGGVDSVKVVKVVRRLVRSQYKYYVQLTIEGEKPQKGRTLGKGNVGIDLGPTTVAVCGENIVSIDKLASKCDNIQSKITRLSRKIDRSRRANNPDNYNEDGTIKRGVKLVWEKEKNLKRYSKLKRELAELRRKQAAIRKLQHIERANALLNEGNTFIVENNPVKAWVRRAKETKVDEKTGKYKSKRGSGRSVGSHAPAMFVDIMENKVKSLGGRFERVDTQNAASRFDFTDGSFTEHDRSVRAVTLSNGDTHQRDMLAAFNLQHLQLDEAKTKQYDTEAMAADYERFCQLEQEEIQRYKNREKKDDRSTIGAEKL

SEQ ID NO: 2906 - protein, 484 aa, Unknown
  Description of Unknown: uncultivated organism sequence
  Category: MG91 effectors
  Description: MG91-97 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNKKERFCGFDYDLSTFTISIKSTCTKKIICTIPFVVNKNSEYELYALSQKICRIGIVRKLIRSKYKYYVQFTFDGVPYNKGRNIGTGIVGIDPGPSKIAIVGDNKVEIAKLAPNIEEDERKTARLKRKLDRSRRATNPHMYKEDGTNIKGQRQICFSKSYNETRKQLADAQRKLAAKRKIAHNELANTLLEYGDTFKVEANSYKSMQARAKATSMTKSGRIRSKKRYGKSIKNRAPSEFLVILKNKLLYYPKGKYYDVPSSYACTQFDFTNESFTEHKISERRIVTSDGIQHNRDTLAAFNIKNAIVNDTSTKKKKVTKSKEFFDIVKMKASYNEFCLMERYLLSV

SEQ ID NO: 2907 - protein, 525 aa, Unknown
  Description of Unknown: uncultivated organism sequence
  Category: MG91 effectors
  Description: MG91-98 effector
MNEVFVLELPLQVEKFQVDILNKRYEQLRQLYNYVQGKLLRQYRYFEQMKEYQACKTFKEKKDFFRSHPFQINETLKGNETAFKVSFDEYSINSYIEKLVQKSVGSNMTYSDLGFTTNILDHLSASIWAAWNKKLYDFKAKRISFKKYGELDSFSSRRKVVRGVVYFSGIELHLDTMELAIKMNGKVGKEAKFITLKMLHNPKHAEYEMWALKGGVDSVKVVKVVRRLVRSQYKYYVQLTIEGEKPQKGRTLGRGNVGIDLGPTTVAVSGENVVSIDKLASKCDNIQEEITRLSRKIDRSRRANNPQNFNEDGTIKRGIKLVWNDSNRYKELRRELAELRRKQAAIRKQQHIDRANSLLKEGDTFIVENNQISSWTTRAKETKVNEKAGKIQKKKRFGKSVANHAPSMFVSILENKVKSLGGEVVKVDTKNAASQYDFTDGSFTKHELKERNVTLSNGDTHQRDMLAAFNLQHLKYEEKDKTKQYDTDAMKKDYERFCQLEQEEIQRYKNKEKKDDSSTIGAGEL

SEQ ID NO: 2908 - protein, 535 aa, Unknown
  Description of Unknown: uncultivated organism sequence
  Category: MG91 effectors
  Description: MG91-99 effector
MAQETFVLELPLKVEKWQADILDKRYEYLRQIYNYVQKKLIRQYKYFEQMNEFRQCTTYRDKREFFRNHPFYYNEVVGRNGEPFAIKFPYSMSESNGAKLDGFNGYISKLGKLPVGANKTYADLGINSFMLERLASNMWSAWNKFLYDRDAKRVAFKKYGELNTFGSRKKNNISFIGMAIHLDTMELVIKTNGRNGQFAEYITLPIGTGKPLTEYEMYALKSGFDSIKILNVVRKQIRGNNKYYLQMTIEGEKPQKGRTLGEGCVGIDLGPSTIAVSSLQKVSIDKLANKCDDIQRDLNRVSRKMERTRRANNPHYINEDGTIKPISRKSGERRVWHDSKRYKKLREERKELLRKQAAIRKAQHIETANALLPLGDTFIVENNPVSSWTRKSKETKINKKGKIQSKKRFGKSVANHAPSMFATILQNKVESLGGQFRKVEVKNAASRFDFTNGEFTEHGLGERVIALSNGDKHQRDLLAAFNLQHLNADGNSTKDYDVATMQKDYPTFCRLEREEMDLYLQGKKKNERTTIGAFK

SEQ ID NO: 2909 - protein, 528 aa, Unknown
  Description of Unknown: uncultivated organism sequence
  Category: MG91 effectors
  Description: MG91-100 effector
MKEVFVLELPLRVEKYQADILNKRYELLRQLYNYVQGKLLRQYRYFEQMKDYQICKTFKDKREFIKAHSFHINGVLGRNKELLDISFDEYGIMGLVTKLGQKLIGSGKTYTDMGISSTILANLSDNIWSSWNKKLYDYHADRITFKKYGSLNTFGSGKIVQKKDNEVKEYFPGMVLHLERMEIEIKTNGGLGKKATFITLPILHNPKHADYEMMALAGGSSSIKVLTIVRRLVRGQYKYYLQMSIEGEKPQKGRMLGKGNVGIDLGPTTVAVSGENIACIDKLASKCDNIQAEITKLARKIDRSRRANNPQNYNEDGTIKRGIKLVWYDSKRYKELRRELAELRRKQAAIRKQQHIDRANALLKEGDTFIVENNQISGWTTRAKETKVNEKTGKIQKKKRFGKSVANHAPSMFVTILENKVKSLGGQVVKVDTQNAASQYDFTNDSFTKHELKERNVTLANGDTHQRDMLAAFNLQHLKYDAKEKKQYDKEAMKAHYEHFCELEQEEIQRYKNKEKKDDRSTIGAEKL

SEQ ID NO: 2910 - protein, 509 aa, Unknown
  Description of Unknown: uncultivated organism sequence
  Category: MG91 effectors
  Description: MG91-101 effector
MRKKTTDENFIMELPLTVDKFQSDELYKRFELMRRIYNSAQNKLKRQYEYLSSFKAYKECKTKKEKGDFLKAHPFSFRGVLDKDGEPLKITFSEYDLKSYLSKFAKQKVDSQYTYSDFGINTSMLMHMAMAIWSAWKKVLYDPKAQEVSFKKHGELQSIGVDWEPKHPAGLILDLQKGELKVNLNNRQGQYARYITMKIKFGHKEHQIWYEGDALNAGEDSIRGLTIVRRKIRGKYNYFLQMTIRNNKPQKGRTLGTGRVAIDLGTCKIAVVTKNSVRLIPLAPSISSYSDELRIIQRQMDRSRRANNPQKYHEDGTIKKGNHDKWISSKEYIRLRDIKAELERKQAAVRKQDHIALANYLLSLGNEFVIEDNDVQEWAKRKKEEKKREKDGKNLSKAGLGKQIGNHAPAMFVTILKNKVESLGGSFIKVDTDNGATDYDFTNDEFTHHELEERYITLSDGKRHQRDTLAAFNLYHINTVQNRVYDRLAMQRHYAWFCEKEAESVEQYK

SEQ ID NO: 2911 - protein, 525 aa, Unknown
  Description of Unknown: uncultivated organism sequence
  Category: MG91 effectors
  Description: MG91-102 effector
MNEVFVLELPLMVEKYQADILNKRYEQLRQLYNYVQGKLLRQYRYFEQMADYQVCKTIREKRDFLKNHPFNINGVLDRRGKLLDITFDEYGIQGFVEKMIHKSVGNNISYADLGLNTLILDYLAASIWRAWDKKLYDLNAKRISFKKHGELDSFSSRRKVVNGTARFFGLELYLDKMELAVKVNGKQGKNAKFITLKIQHNPKHVDYEMWALKGGVDSVKVVKVVRRLVRSQYKYYVQLTIEGEKPQKGRTLGKGNVGIDLGPTTVAVSGKNVVSIDKLASKCDNIQEEITRLSRKIDRSRRANNLQNFNEDGTIKRGIKLVWNDSKRYKELRRELAELRRKQAAIRKQQHIDRANALLKEGDTFIVENNPVKAWAARAKETKVNEKTGKIQSKKRGGKSIGNHAPAMFVDILENKVKSLGGTFIRANTNNAASQYDFSNNSFKEGEDRHGLNERAITLSNGNTHQRDMLAAFNLQHLTDEKKQYDVEAMKRDYERFCQLEQEEIQRYKNKEKKDDRSTIGAEKL

SEQ ID NO: 2912 - protein, 524 aa, Unknown
  Description of Unknown: uncultivated organism sequence
  Category: MG91 effectors
  Description: MG91-103 effector
MNEVFVLELPLLVERYQADILNKRYEQLRQLYNYVQGKLLRQYRYFEQMKEYKACEKIKEKRDFFRAHPFHINGVLNGNKEQLDITFDKNGINGFVEKLAQKSAGPNITYADLGFTTYILDHLSASIWAAWEKKLYDFKAKRISFKKYGELDSFSSRRKVVGGKVYFSGMELHLDTMKLSIKMNGKQGDNAKFITLKMLHNPKHTDYEMWALKGGVDSVKVVKVVRRLVRSQYKYYVQLTIEGEKPQKGRKLGKGNVGIDLGPTTVAVSGENVVSIDKLASKCDNIQEEITRLSRKIDRSRRANNPQNFNEDGTIKHGIKLVWNDSKRYKELRRELAELRRKQAAIRKLQHIERANTLLKEGDTFIVENNQISGWATRAKETKVNEKTGKIQKKKRFGKSVANHAPSMFINILENKVKSLGGEVVKVDTKNAASQYDFTDGSFTKHELKERNVTLSNGDTHQRDMLAAFNLQHLKYDEAEAKQYDTEAMAADYERFCQLEQEEIQRYKNKEKKDDRGTIGAEKL

SEQ ID NO: 2913 - protein, 484 aa, Unknown
  Description of Unknown: uncultivated organism sequence
  Category: MG91 effectors
  Description: MG91-104 effector
MAHKENQKAFVVTFPLHTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNKKERFCGFDYDLSTFTISIKSTCTKNIICTIPFVVNKKSDYELYALSQKICRIGIVRKLIRSKYKYYVQFTFDGVPYNKGRNIGTGIVGIDPGPSKIAIVGDNKVEIAKLAPNIEEDERKTARLKRKLDRSRRATNPHMYKEDGTNIKGQRQICFSKSYNETRKQLADAQRKLAAKRKIAHNELANTLLEYGDTFKVEANSYKSMQARAKSTSMTKSGRIRSKKRYGKSIKNRAPSEFLVILKNKLLYYPKGKYYDVPSSYACTQFDFTNESFTEHKISERRIVTSDGIQRNRDTLAAFNIKNAIVNDTSTKKKKVTKSKEFFDIVKMKASYNEFCVMERYLLSV

SEQ ID NO: 2914 - protein, 524 aa, Unknown
  Description of Unknown: uncultivated organism sequence
  Category: MG91 effectors
  Description: MG91-105 effector
MEEVFVLELPLQVEKYQADILNKRYEQLRQLYNYVQGKLLRQYRYFEQMAEFQACKTIREKRDFFRSHPFHINGKLAGNKELPEITFDEYGINGFVEKMAQKSVGTNMTYADLGFTTYILDHLSASIWTAWEKKLYDYRATRISFKKYGELDSFSSRRKVVRGKAYFSGVELHLDSMELAIKLNGKVGKNAKFITLPILHNPKHADYEMWALKGGLDSVKVVKVVRRLVRGQYKYYVQLSIEGEKPQKGRTLGKGNVGIDIGPTTVAVSGENIASIDKLASKCDNIQEEITRLARKIDRSRRANNPENFNEDGTIKRGVRLVWNDSKRYKALRKEMAELQRRQAAIRKQQHIDRANALLKEGDTFIVENNQISGWTRKAKETKVNEKTGKIQKKKRFGKSVANHAPAMFVTILENKVKSLGGKVIKVDTQNAASQYDFTNNSFEKHELKERSVTLSNGDTHQRDMLAAFNLQHLKYDKAEKKQYDTEAMAQHYERFCELEQEEIMRYKKKEKKSDRSTIGAEEL

SEQ ID NO: 2915 - protein, 526 aa, Unknown
  Description of Unknown: uncultivated organism sequence
  Category: MG91 effectors
  Description: MG91-106 effector
MKEVFVLEMPLLVEKYQEDILNKRFEQLRQLYNYVQGKLLRQYKYFEQMAEFQICKTSKAKREFIKTHPFHINGVIGRNKDLLDISFDEYGILGLVTKLGQKPLGSGKSYADMGISSTILANLSNNIWSAWNKKLYDYHAKRISFKRYGELNSFGSGKIVQKKDNDVKEYFPGFILHLERMELDIKTSKSGKNETCITLPILHNPKHADYEMWALKDGSTSIKVLTIVRRLVRGRYKYYLQMSIEGEKPQKGRTLGKGNVGIDIGPTTVAVSGENIASIDKLASKCDNIQEEITRLARKIDRSRRANNPQNFNEDGTIKRGVRLVWNDSKRYKALRKEMAELQRKQAAIRKQQHIDRANALLKEGDTFVVENNPIKGWQARAKETKIDEKTGRFKSKKGRGKSIGNHAPAMFVTILENKVKSLGGEVVKVDTHNAASQYDFTNESFTDHGYDRKITLSNGDTHQRDMLAAFNLQHLKYDETEKKQYDTEAMVQHYDRFCELEQEEILRYKNKEKKDDRSTIGAGDL

SEQ ID NO: 2916 - protein, 483 aa, Unknown
  Description of Unknown: uncultivated organism sequence
  Category: MG91 effectors
  Description: MG91-107 effector
MAHKENQKAFVVTFPLRTERWQEDRIDKMMKMLTTYYNDRQKKLVGRYIYLSHSKAFKEAKGKGVVAFKKYMQENGFSKYDLDAFFKANTKGAIYQIGLNSNNIQYLSQCAWSAWERKLFGNGKFIKTDIDVNIFKSRRKNDSFAGFAYDIGSFTITIKSTYARNNICTIPFIVNRKSEYELFAMSQEIRNIAIVRKVIRGVNKYYVQFTVEGAPYNKGRHLGTGTVGIDPGPSKMAIVADKVVEINKLAPNIEEDEKVTARLKRKLDRSRRATNPHMYNEDGTSKKGQRQTIFSKSYDKTRKQLAEAQRKLTAKRKIAHNELANKILEYGDTFKVETNSFKSMQARSKTTSTTKNGRIRSKKRYGKSIKNRAPSEFLLILKNKLLQYSSGKYYDVPASYACTQFDFTDESFTEHKVSERSIITSDGIQHNRDTLAAFNIKNAIVSDTTSKKRKIVKSKEFFDINVMKETYRAFCEMESKLLA

SEQ ID NO: 2917 - protein, 528 aa, Unknown
  Description of Unknown: uncultivated organism sequence
  Category: MG91 effectors
  Description: MG91-108 effector
MNEVFVLELPLLVEKYQADILNKRYEQLRQLYNYVQGKLLRQYKYFEQMKEYQACEKIKEKRDFFRTHPFQINETLKGNKIPFKVSFDEYSIKGYIEKLAQKQIGSNMTYADLGFTTNIFDHLGASVWAAWDKKLYDFKAKRISFKKYGDLDSFSSRRKIVRGVVYFSGMELHLDTMELAIKMNGKVGKEAKFITLRMLHNPKHADYEMWALKGGVESVKVVKVVRRMVRSQYKYYVQLTIEGEKPQKGRTLGKGNVGIDLGPTTVAVSGENVVSIDKLASKCDNIQEEITRLSRKIDRSRRANNPQNFNEDGTIKRGIKLVWNDSKRYIELCRELAELRRKQAAIRKQQHIDRANALLKEGDTFIVENNPVNAWVRRAKETKVDEKTGKYKSKRGSGRSVGNHAPAMFVDILENKVKSLGGRFERVNTQNAASQYDFTIDSFKTGDDKHKLNERAITLSNGDTHQRDMLAAFNLQHLKYDEAEAKQYDTEAMAADYERFCQLEQEEIQRYKNKEKKDDRSTIGAEKL

SEQ ID NO: 2918 - protein, 524 aa, Unknown
  Description of Unknown: uncultivated organism sequence
  Category: MG91 effectors
  Description: MG91-109 effector
MMKEVFVLELPLLVEKYQADILNKRYEQLRQLYNYVQGKLLRQYRYFEQMVEFQACKTIREKRDFFRSHPFHVNGRLAGDKELPEITFDEYGIKGFVEKLAQKSVGPNMTYADLGFTTYILDHLGANIWSAWDKKLYDYRAKRISFKKFGELDSFSSRRKVVGGKVYFSGMELRLDTMELAIKLNAKQGKNAKFVTLRILHNPKHADYEMWALNGGLDSIKVVKVVRRLVRGQYKYYVQLSIEGEKPQKGRTLGKGNVGIDIGPTTVAVSGENIASIDKLASKCDNIQEEITRLARKIDRSRRANNPENFNEDGTVKRGVRLVWKDSKRYKELRKEMAELQRRQAAIRKQQHIDRANALLKEGDTFIVENNPIKGWAARKKETKIDEKTGKYKSKKGRGKSIKNHAPAMFVTILENKVKSLGGKVERVDTQNAASRFDFTDGSFTDHGYDRKVTLSNGDTHQRDMLAAFNLQHLKYDEAEKKQYDTKAMAQHYDRFCELEQEEIQRYKNKEKKDDRSTIGAGEL

SEQ ID NO: 2919 - protein, 383 aa, Unknown
  Description of Unknown: uncultivated organism sequence
  Category: MG91 effectors
  Description: MG91-110 effector
MFLQYLSQCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSTKKKKITKSNEFFDIVRMKASYNEFCLMERYLLSI

SEQ ID NO: 2920 - protein, 533 aa, Unknown
  Description of Unknown: uncultivated organism sequence
  Category: MG91 effectors
  Description: MG91-111 effector
MKAIEIMKEVFVLELPLQVEKYQADILNKRYEQLRQLYNYVQGKLLRQYRYFEQMLEFQACKTIREKRDFFRSYPFHINGIVGRNKELLDLSFSEYGILGLVTKLGQKPVGSGKTYADVGISSTILANLSNNIWSAWNKKLYDLHAKKISFKKYGELNTFGSGKIVQKKENEVKEFFPGMVLHLERMEIDIKTSKSGKNETYITLPILPNPKHADYEMWALKGGSSSIKVLTIVRRRVRGLYKYYLQMSIEGEKPQKGRTLGKGNVGIDIGPTTVAVSGENIASIDKLASKCDNIQEEITRLARKIDRSRRANNPENFNEDGTIKRGVRLVWKDSKRYKALRKEMAELQRRQAAIRKQQHIDRANALLKEGDTFIVENNQISGWTRKARETKVNEKTGKIQKKKRFGKSVANHAPAMFVTILENKVKSLGGEVVKVDTQNAASQYDFTNNSFEKHELKERSVTLSNGDTHQRDMLAAFNLQHLKYDEAEKKQYDREAMTQHYERFCELEQAEIQRYKNKEKKDDRSTIGAGDL

SEQ ID NO: 2921 - protein, 605 aa, Unknown
  Description of Unknown: uncultivated organism sequence
  Category: MG91 effectors
  Description: MG91-112 effector
MIEEFVLTLPLKVETWQADILNNRYEHLRCIYNMVQRKLLRHYIYLSQQNEYRQCKDNDEKRTFWENHPITFKDFCDKNGNPAIVKFPYTYSHRSKDSGKKASNGISDFVPKFKNRNIGGGLTYGSLGINASILENLGLRIEQAWKKRLYDPKSKHISFKEEGDLNTFGCREKDGFSGFVLDLQKMTLSFNTNGRQGKSAKFIHFPINAGKELTEYEMYALKGGIGSIRKIVVSREYVRGRYKYYVQLTIKEEKPQKNRTLGKGTVGLDVGPSTVAVSSLHGVSLDKLADKCDNIEHDLWRINRKMDRSKRDTNPDFFNEDKTYKKPEKGERRKWTFSNRYKRLKLERRELYRKQAAIRKQQHIEMVNALLSQGDEFIVENNPIDSWAKRAKETKRGKNGKIRCKRRFGKSVAHHAPAMFVSILQNKVRSLGGTFHKVEIKNAATQFDFTNGEFTKHELNERTVTLSNGRTHQRDMLSAFNLQHLRPDSEETKDYNIEQMEADYPVFCKLEEKGIAQFKEKRQQERDVAYFTGVSHKTLKFSSANRHNGGVGRKNCNHHAGSKRNVAETGNKSSSKENCESMETVSLVPNEYHHSNHQHLRLDGL

SEQ ID NO: 2922 - protein, 528 aa, Unknown
  Description of Unknown: uncultivated organism sequence
  Category: MG91 effectors
  Description: MG91-113 effector
MNEVFVLELPLQVEKYQADILNKRYEQLRQLYNYVQGKLLRQYRYFEQMKEYQACEKFREKKDFFKSHPFHINETLKGNKTPIKVSFDEYSIKGYIEKLAQKPVGPNMTYADIGFTTYILDHLGASIWSAWDKKLYDFKAKRISFKKYGELDSFSSRRKVGRGVIYFSGMELHLDTMELAIKMNGKVGKGAKFITLKILHNPKHADYEMWALKGGLESIKVVKVVRRLVRSQYKYYVQLTIEGEKPQKGRTLGKGHVGIDLGPTTVAISSENVVSIDKLASKCDNIQNEITKLGRKINRSRRASNPQNFNEDGTIKRGIKLVWNDSKRYKELRRELAELHRKQAAIRKLQHIERANALLKEGDTFIVENNPVNAWSRRSNETKVDEKTGKFKSKRGSGRSIGNHAPSMFVDILENKVKSLGGRFERVNTQNAASQYDFTTDSFKTGDEKHKLNERAITLSNGDTHQRDMLAAFNLQHLKLDEEKPKQYDTEAMAADYNRFCQLEHEEIMRYKNKEKKDDNSTIAAGKL

SEQ ID NO: 2923 - protein, 525 aa, Unknown
  Description of Unknown: uncultivated organism sequence
  Category: MG91 effectors
  Description: MG91-114 effector
MKEVFVLELPLQVEKYQEDILNKRYEQLRLLYNYVQRKLLRQYRYFEQMDDFQACKTFKEKRDFFKSHPFHINGIIGSNKELLDITFDDYGINGFVTKLGSKSISDENTYSDMGINSAILAKLSDNIWSSWDKMLYDHKAKRISFKRYGDLNSFGCGKKTNGSGKKVFSGLELHLETMTLAIKLNSKVGKSAKFITLPILHNPKHADYEMMALKGGIDSVKVVKVVRRMVRGRYKYYLQMTIEGEKPKKGRLLGKGNVGIDLGPTTVAVSGESIASIDKLASKCDNIQEEITRLARKIDRSRRANNPENYNEDGTIKCGVHLAWNNSKRYKALRREMAELRRKQAAIRKHQHIDRANALLKEGDTFIVENNQISGWTRKAKETKVNEKTGRIQKKKRFGKSVANHAPAMFVTILENKVKSLGGEVVKVDTQNAASQYDFTNDSFEKHELKERNVTLSNGDTHQRDMLAAFNLQHLKYDEAEKKQYDREAMAQHYERFCELEQEEIMRYKNKVKKDDRSTIGTGNL

SEQ ID NO: 2924 - protein, 528 aa, Unknown
  Description of Unknown: uncultivated organism sequence
  Category: MG91 effectors
  Description: MG91-115 effector
MNEVFVLELPLQVEKYQADILNKRYEQLRQLYNYVQGKLLRQYRYFEQMKEYQACKTIKEKRDFFKSHPFQVNESLGGDKSAFEISFNEFSIKGFIEKLVQKSVGANMTYADLGFTTNILDHLGASVWAAWDKKLYDFKAKRISFKKYGELDSFSSRRKVVGGKVYFSGMELHLDTMELAIKMNCKQGNNAKFITLKMQHNPKHAEYEMWALKGGVDSVKVVKVVRRLVRSQYKYYVQLTIEGEKPQKGRTLGMGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISSWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYDEKDTKQYDTEAMTADYERFCQLEQEEIQRYKNKEKKDDKGTIGAEKYESKV

SEQ ID NO: 2925 - protein, 525 aa, Unknown
  Description of Unknown: uncultivated organism sequence
  Category: MG91 effectors
  Description: MG91-116 effector
MENEIFVLEMPLKVEKWQADILNKRYEYLRQIYNYVQGKLLRQFRYFEQMEEYQQCKTFKDKRTFISNHPFHIKGINDKSGNPQPITFTKLSISCFAEKLAKRQIGKDKTYLDVGINTNIIKEQTFNLWKSWEKYLYDYSAHRVAFKKKDELNIFRYGKKGDGFNGMAVNLEKMEVTIKTNGRQGNNATFLTLSVDCGKGMTEYELFALKGDIASINTVAIIRRNIRGQFKYYVQFNIEGEKPQKGRTLGVGKVGIDIGPSTIAVASLNNVSIDKLADRCDDIQHDLNIVSRKIDRSRRANNPQNFNADGTIKRISRQKGERRVWNDSNRYKKLKAERAELLRKQAAIRKNQHILKANELLEMGDTFIVENNPVDGWTRRTKETKFDKRGKIQSKKRYGKSVANHAPSMFVTILENKVKSFGGTFVRADVKNAASQFDFTSGEFTKHEVGERTVTLANGDKHQRDMMAAFNLQHLNIESEELKDYDIEQMKSDYPNFCSQEREELNRYIRKEKKDERTTIGAFRK

SEQ ID NO: 2926 - protein, 606 aa, Unknown
  Description of Unknown: uncultivated organism sequence
  Category: MG91 effectors
  Description: MG91-117 effector
MAKETFVLTLPLKVEKWQADILDKRYELLRQIYNMVQQKLLRQYIYFSQQKAFKACKGDFQKMREFFASHPFHFKGIKGRNGEPSDIKFPYTYESRSSSSGRRAPNGISDFVSKLGAHKIGKDKTLSDFGINSCILEELGLHVMQAWEKRIYESKSSRVSFKKYGDINSFGSRCKNGSFAGFTFNLEKSHITFNTNGRQRKCAKLITLPIDFSREKKGYAASALKGGIDSLRKLIIVRKCIRGKNKYYLQLTIGGEKPQKGRTLGHGNVGIDVGPSTIAVSSLQCVHFNKLADKCDNIEHDLFLVNRKLDRSRRANNPQNYNADGTVKRGVRLVWKKDKDVKRYASLKLHRKELYRKQAEIRKQQHLQMANAILSEGDTFIVENNPIDAWVRRAKETTKTKTGKNRCKKRYGKSVANHAPAMFVSILKNKVQSLGGVFHEVDVRYAATQFDFTNGTKTKHEVSERSITLSNGHTHQRDMLSAFNLQHIKLECIGTEDKDYDIKQMQADYPIFCKLEAAEQERFKVARHNERDALYFVGASEKQLRHQPQDESVANRHNGGVGRKHCNTRLGSENAEITGSGLIRESIERVPQVSDEYHISGHPPIV

SEQ ID NO: 2927 - protein, 609 aa, Unknown
  Description of Unknown: uncultivated organism sequence
  Category: MG91 effectors
  Description: MG91-118 effector
MAKETFVLSLPLIVEKWQADILDKRYELLRQTYNMVQQKLLRQYIYFAQQKTFKACENFQQKRDFFASHPFHFKGIKGRNGELSDIKFPYTYESRSSSSGKRPSGGISDYVSKLWAHRISQDKTLADFGINGSILEELGLHIMKAWETRLYEPKASRVSFKDYGTVNSFGCRYHKGNFAGFTINLEEGYITYNTNGRRGSLANIIKLPIDYSREKKGYASEALKGGVDSLRKLVIVRKIIRGRNKYYLQLTISGEKPQKGRILGHGNVGIDIGPSTIATSSLQGVHFDKLADKCDNIEHELYLVNRKLDRSRRANNPQNYNEDGTIKRGIRLVWKKDKDAKRYASLKLLRKELYRRQAEIRKLQHLEMANAMLSQGDTFIVENNPIDAWVRRTKETAKTKTGRNRCKKRYGKSVANHAPAMFVSILKNKVLSLGGQFHEVDVRYAATQFDFTNGVKTKHEVGERSITLSNGRTHQRDMLSAFNLQHITLESIGTEDKDYNIEQMYADYPIFCKLESAEQERFKVARKNERDALYFVGVSEKNLRHQHHKETVVNRHNGDVGRKHCNNSLEKENAKITGNGLIRESIERVSEVPDKYHLVGNHPIVLDGL

SEQ ID NO: 2928 - protein, 550 aa, Unknown
  Description of Unknown: uncultivated organism sequence
  Category: MG91 effectors
  Description: MG91-119 effector
MTRTRTTLDNSYVALITPKDEGYLKKMNEVFVLELPLQVEKYQADILNKRYEQLRQLHNYVQDKLLRQYRYFEQMKEYQACEKIKEKREFFRAHPFQINETLKGNKTSFKVSFDEYRIKGYIEKLAQKQVGLNTTYADLGFTTYILDHLGASVWAAWDKKLYDFKAKRISFKKFGELDSFSSRRKVVGGKVYFSGMELHLDTMELAIKMNGKVGKEAKFITLKMLHNPKHADYEMWALKDGVDSVKVVKVVRRLVRSQYKYYVQLTIEGEKPQKGRTLGKGHVGIDLGPTTVAVSGENIVSIDKLASKCDNIQEEITRLSRKIDRSRRANNPQNFNEDGTIKRGIKLVWNDSKRYKELRRELAELRRKQAAIRKQQHIERANALLKEGDTFIVENNQISGWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYNEAEAKQYDTEAMAADYERFCQLEQEEIQRYKNKEKKDDKGTIGAEKF

SEQ ID NO: 2929 - protein, 524 aa, Unknown
  Description of Unknown: uncultivated organism sequence
  Category: MG91 effectors
  Description: MG91-120 effector
MNEVFVLELPLQVEKYQADILNKRYEQLRQLYNYVQGKLLRQYRYFEQMKEYQACKTIREKRDFFRSHPFLINETLKGNKTPFTVSFDEYSIKGFVEKLAQKPVGPNMTYADLGFTTPILDHLGASIWAAWDKKLYDFKAKRISFKKYGELDSFSSRRKVVRGVVYFSGMELHLDTMELAIKMNGKVGKEAKFISLKMLHNPKHADYEMWALKGGVDSVKVVKVVRRLLRNQYKYYVQLTIEGEKPQKGRTLGKGNVGIDLGPTTVAVSGKNVVSIDKLASKVDNFQEEITRLSRKIDRSRRANNPQNFNEDGTIKRGIKLVWNDSKRYKELRRELAGLRRKQAAIRKQQHIERANALLKEGDTFIVENNQISGWTTRAKETKVNEKTGKIQKKKRFGKSVANHAPSMFVSILENKVKSLGGDLVKVDTKNAASQYVFTDNSFSKHELKERNVTLSNGDTHQRDMLAAFNLQHLKYDEKDTKQYDTAAMTADYERFCQLEQEEIQRYKNKEKKDDRSTIGAEDL

SEQ ID NO: 2930 - protein, 529 aa, Unknown
  Description of Unknown: uncultivated organism sequence
  Category: MG91 effectors
  Description: MG91-121 effector
MNEVFVLELPLQVEKYQADILNKRYEQLRQLYNYVQGKLLRQYKYFEQMKEFQACKTFKEKKDFFRSHPFHIDGILGSNKELYDITFDEYGINGFVGKLGKKQVSAGVTYADLGITSTLLDRLSLAVWAAWDKMLYDYHSRRVSFKKNGELNIFGSRKKTNGSGKKMFSGMELHLEKMEVAIKLNGKVGKAAKFITLPILHNPKHIDYEMWALKGGFDSVTVLTIVRRMVRSQYKYYVQLTVEGEKPQKGRTLGKGNVGIDLGPTTVAVSGEHIVSIDKLASKCDNIQEEITRLSRKIDRSRRANNPQNFNEDGTIKRGIKLIWNHSKRYKELRRELAELRRKQAAIRKLQHIDRANALLKEGDTFIVENNQISGWTTRAKETKVSEKTGKIQKKKRFGKSVANHAPSMFVSILENKVKSLGGEVVKVDTKNAASQYDFTNNSFKKHELKERNVTLSNGNTHQRDMLAAFNLQHLKYNEPEAKQYDTEAMAADYKRFCQLEQEEIQRYKNKEKKDDRSTIGAEELNIKE

SEQ ID NO: 2931 - protein, 528 aa, Unknown
  Description of Unknown: uncultivated organism sequence
  Category: MG91 effectors
  Description: MG91-122 effector
MNEVFVLELPLQVEKYQADILNKRYEQLRQLYNYVQGKLLRQYKYFEQMKEYQSCRTFKEKKDFFRNHPFQIKGVLGRNKELLDIFFDEYGIFGLVTKLGQKPMGSGMSYTDMGISSTILANLSYNIWSSWNKKLYDYHADRISFKKHDGLNTFGSGKIVKKKDNEVKEYFPGMVLHLDRMEIDIKTNGGLGKKTTFITLPILYNPKHADYEMMALKGGTKSIKVLTVVRRLVRGQYKYYLQLTIEGEKPQKGRTLGKGNVGIDLGPTTVAISGKNVVSIDKLVSKCDNIQEEITRLSRKIDRSRRANNPQNYNEDGTIKRGIKLVWNDSKRYKELRRELAELRRKQAAIRKQQHIDRANALLKEGDTFIVENNQISGWATRAKETKVNEKTGKIQKKKRFGKSVANHAPSMFINILENKVKSLGGEVVKVDTKNAASQYDFTDGSFTKHELKERNVTLSNGDTHQRDMLAAFNLQHLKYDEAEAKQYDTEAMAADYERFCQLEQEEIQRYKNKEKKDDRGTIGAEKL

SEQ ID NO: 2932 - protein, 484 aa, Unknown
  Description of Unknown: uncultivated organism sequence
  Category: MG91 effectors
  Description: MG91-123 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARAKATSMTKSGRIRSKKRYGKSIKNRAPSEFLVILKNKLLYYPKGKYYDVPSSYACTQFDFTNESFTEHKISERRIVTSDGIQHNRDTLAAFNIKNAIVNDTSTKKKKVTKSKEFFDIVRMKASYNEFCLMERYLLSV

SEQ ID NO: 2933 - protein, 524 aa, Unknown
  Description of Unknown: uncultivated organism sequence
  Category: MG91 effectors
  Description: MG91-124 effector
MKEVFVLDLPLRVEKYQSDILNKRFEQLRQLYNYVQGKLLRQYRYFEQMKEYQACKTFKEKKDFFRKHPFHINGILGSNKELLDITFDEYGIKGFVEKLVQKGVGTDMTYADLGFTTYILDHLSAGIWSAWDKMLYDYKARRISFKKYGELDSFSSRRKVVQGKVYFSGMELHLDSMMLSVKMNGKVGKAAKFITLPILHNPKHANYEMWALRGGLDSVKVVKVVRRLIRGQYKYYVQMTIEGEKPQKGRTLGKGNVGIDLGPTTVAVSSENIVSIDKLASKCDSIEAEKAKLGRKIDRSRRANNPQNFNEDGTIKRGVRLVWNDSKRYKALRGEMAELQRRQSAIRKQQHIDRANELLKEGDIFIVENNQISGWTRKTKETRVDESTGRIRKKKRFGKSVANHAPSMFVNILENKVKSLGGQLVKVDTQNAASQYDFTDGSFTKHELQERNVTLSNGDTHQRDMLAAFNLQHLKYDEAEKKQYDREAMSKHYERFCELEQAEILRYKNKEKVDDRSTIGAKEL

SEQ ID NO: 2934 - protein, 527 aa, Unknown
  Description of Unknown: uncultivated organism sequence
  Category: MG91 effectors
  Description: MG91-125 effector
MEEVFVLELPLQVEKYQADILNKRYEQLRQLYNYVQGKLLRQYKYFEQMKEYEVCKSIREKRDFFRNHPFHITGVLDKSGEPLDITFDEYGIQGFVEKIIHKSVGANTTYADLGFNTLILDYLSASIWSAWDKKLYDFKAKRISFKKYGELDSFSSRRKVVRGVVYFSGMELHLDTMELAIKMNGKVGKEAKFITLKMLHNPKHADYEMWALKGGVDSVKVVKVVRRLVRSQYKYYVQLTIEGEKPQKGRTLGKGNVGIDLGPTTVAISGKNVVSIDKLASKCDNIQEEITRLSRKIDRSRRANNPQNFNEDGTIKRGVKLVWNDSKRYKELRRELAELRRKQAAIRKQQHIDRANALLKEGDTFIVENNQISGWTTRAKETKVNEKTGKIQKKKRFGKSVANHAPSMFVSILENKVKSLGGEVVKVDTKNAASQYDFTDGSFTKHELKERNVTLSNGNTHQRDMLAAFNLQHLKYDEAEAKQYDTDAMAADYERFCQLEQEEIQRYKNKEKKDDRGTIGVEQLLKT

SEQ ID NO: 2935 - protein, 603 aa, Unknown
  Description of Unknown: uncultivated organism sequence
  Category: MG91 effectors
  Description: MG91-126 effector
MAKENFVLTLPLRVEKRHADILDKRYELLRQMYNMVQQKLVRQYIYFSQQKAYKACENFEQKREFFNTHPFHFKGIKGKNGELCDIKFPYTYESRSSSSGKRPSGGISDYVSKLWSHKVGADKKLVDFGLNGSIMEELGLHVMKAWEDRLYKFKARRVSFKDYGEINSFGCRYHKGNFAGFTINLEEGFITFNANGRRGQFAEIITLPIDFSREKKGYAEEALKGGVDSLRKLIIVRRCIRGRNKYYLQLTISGEKPKKGRTLGMGNVGIDVGPSTIAISSLQGVHFDKLADKCDNIEHKLYLINRKLDRSRRANNPDNYNPDGTIKRGVRLVWKKDKDVKRYASLKQQRKELFRKQAEIRKQQHLEMANAMLSQGDTFIVENNPIDAWVRRAKETKKTKTGKNRCKKRYGKSVANHAPAMFVSILKNKVLSLGGEFREVNPGYAATQFDFTNGVFTKHEVSERSITLSNGRTHQRDMLSAFNLQHICNELKEYNITQMQADYPIFCRLETAEQERFKEARRNERDALYFVGAFAKELRHSPQEETVANRHNGGVGRKHSNTLCTENAKITGSGLVRESIERVSEAPEECYHFDCQPIILDGL

SEQ ID NO: 2936 - protein, 528 aa, Unknown
  Description of Unknown: uncultivated organism sequence
  Category: MG91 effectors
  Description: MG91-127 effector
MKEIFVLELPLQVEKYQADILNKRYEQLRQLYNYVQGKLLRQYRYFEQMKEFQICKTIKERKDFFRSHPFHINGVLNSNKELLDITFDEYGINGFVSKLGKKQVCTDTTYADLGITSTLLDRLSLAVWAAWDKMLYDYHAKRISFKKYGELNVFGSRKKTNGSGKKVFSGMELHLEKMEVAIKLNGKVGKAAKFITLPILHNPKHAEYEMWALKDGYDSVTVLTIVRRMVRRHYKYYVQLTIEGEKPQKGRTLGKGNVGIDLGPTTVAVSGKNIVSIDKLASKCDNIQAEITRLSRKIDRSRRANNPQNFNEDGTIKRGVKLVWKKEKDLKRYSKLKRELAELRRKQAAIRKQQHIERANELLKEGDTFIVENNPVKAWVRRAKETKVDEKTGKIRSKRGSGRSVGNHAPAMFVDILENKVKSLGGRFERVETQNAASRFDFTNESFTEHDRSVRAITLSNGDTHQRDMLAAFNLQHLKLEDTKTKQYDIEAMAADYDRFCQLEREEIMRYKNKKKKDDRSTIGAEKL

SEQ ID NO: 2937 - protein, 516 aa, Unknown
  Description of Unknown: uncultivated organism sequence
  Category: MG91 effectors
  Description: MG91-128 effector
MEKKKEMFVVELPLKVEKWQSDVLNKRYELITKIYNYAQKKLLRQYIYLTQMDDYKKCKTKKDKSVFFKNHPFYFKGITSKITFSEYDVTAFFEKIIKKNVSSDKTYKDFGINTSITGYLGKHAWSAWEKKIYGTGKKISFKNKGELSTISIRKKSEYFGGLDVDIEHMILSFNINGKTKSKAKKIILPINTKNLTEYEMYALKGGYDSIKVVTIVSKMIRGKYKYYVQFTIEGEKPQKGRTLGKGNVGIDIGPSTVAISSLNGVTIDTLAEKCDNIEDKISDIERKLDRSRRATNPQNFTEDGQIKRIDRKKGEKRKWEYSKRYVKLNNKKRELLRKQAAIRKLQHNIKANEVLSLGDTFIVENNPTSAWAKRAKGVRKNKNGKIQTNKRFGKSIGNHAPAMFVTILQNKVESLKGKFVKVDIKNAASRFDFTNGDFTEHNLDERKITLSNGNTHQRDMLAAFNLQHIDLTNDDLKKYNVEEMMEDYPIFCKLEKEEIKRFTNGMKIPNKSNIGI

SEQ ID NO: 2938 - protein, 527 aa, Unknown
  Description of Unknown: uncultivated organism sequence
  Category: MG91 effectors
  Description: MG91-129 effector
MTEVFVLELPLQIEKYQADLLNKRYEQLRQLYNYVQGKLLRQYRYFEQMKEYQACKTIKEKRDFFRSHPFQINETLKGNKTLFTVSFEEYSIKGFVEKLAQKPVGSNMTYADLGFTTYILDHLGASIWAAWDKKLYDFKAKRISFKKYGELDSFSSRRKVVRGVVYFSGMELHLDTMELAIKMNGKVGKEAKFITLKILHNPKHAEYEMWALKGGVDSVKVVKVVRRLVRSQYKYYVQLTIEGEKPQKGRTLGKGNVGIDLGPTTVAVSGMNIVSIDKLASKCDNIQPKITRLSRKLDRSRRANNPDNYNEDGTIKRGVKLVWKKEKDLKRYSKLKRELAELRRKQAAIRKQQHIDRANELLKEGDTFIVENNQISGWTTRAKETKVNEKTGKIQKKKRFGKSVANHAPSMFVSILENKVKSLGGEVVKVDTKNAASQYDFTNNSFTKHELKERNVTLSNGDTHQRDMLAAFNLQHLKLDEAKTKQYDTEAMAADYVRFCQLEQKEIQRYKNKEKKDDRGTIGAEKL

SEQ ID NO: 2939 - protein, 524 aa, Unknown
  Description of Unknown: uncultivated organism sequence
  Category: MG91 effectors
  Description: MG91-130 effector
MNEVFVLELPLQVEKYQADILNKRFEQLRQLYNYAQGKLLRQYRYFEQMKEYQACKTFKDKKDFFKNHPFQIHGIQGSNKQPLDITFDEYGINGFVEKLVQKSAGPNVTYADLGFTTNILDHLSASIWRAWDKMLYDYHAKRVSFKKYGELDSFSSRRKVVSGKVYFSGMELHIDTMELSVKLNGKQGANAKFITMPIQYNPKHEDYELWALKGGLTSVKVVKVVRRLVRSQYKYYVQLTIEGEKPKKGRTLGKGNVGIDIGPTTVAVSGENIASIDKLASKCDNIQAEITRLGRKIDRSRRANNPQNFNEDGTIKRGVRLVWNDSKRYKALKREMVELQRRQAAIRKQQHIDRANALLKEGDTFIVENNQISGWTKRAKETKINEKTGKIQKKKRFGKSIANHAPSMFVTILENKVNSLGGKVVKVDTQNAASQYDFTDGSFEKHELNERSVTLSNGDTHQRDMLAAFNLQHLKYDEKEKKQYDVEAMKKHYERFCELEQDEIMRYKNKEKKDDRSTIGAEKF

SEQ ID NO: 2940 - protein, 609 aa, Unknown
  Description of Unknown: uncultivated organism sequence
  Category: MG91 effectors
  Description: MG91-131 effector
MAKENFVLTLPLKVEKCHADILDKRYELLRQTYNMVQRKLLRQYIYFAQQKEYKACENFQQRRDFFASHPFHFKGINSKNGEPADIKFPFTYESRSSNSGKRPSGGISDYVSKLWAHRVGADKTLANLGINSYILEELGLHIMKAWEKRLYDPKSSRVSFKDYGGVNSFGSRYKKGNFAGFTINLEEGFITYNANGRQGRFADLIKLPIDFSREKKDYAAYALKGGIDSLRKLIILRKNIRGRNKYYLQLTISGEKPQKGRALGQGNVGIDIGPSTIATSSLQGVHFDKLADKCDDIEHELYLINRKMARSRYENNRQNYNADKTIKRGVRLVWKKDKDVKRYASLKLKRRELYRRQAEIRKLQHLEMANAMLSQGDTFIVENNPIDAWVRRAKETTKTKTGRNRCKKRYGKSVANHAPAMFVTILKNKVESLGGKFYEVDVRYAATQFDFTNGVKTKHEVSERSITLSNGHIHQRDMLSAFNLQHIKLESIGTDDKEYNIEQMKADYPIFCQLETAEQQRFKEARHNERDAQYFVGAQEKQLRHQPQDESVANRHNGGVGRKHCNTRLEGENAKITGSGLVRESIERVSQVPDEYHPIGDQPIILDGL

SEQ ID NO: 2941 - protein, 615 aa, Unknown
  Description of Unknown: uncultivated organism sequence
  Category: MG91 effectors
  Description: MG91-132 effector
MAKENFVLTLPLRVNKCQADILDKRYELLRQMYNMVQQKLVRQYIYFSQQKAYKACENFEQKREFFNAHPFHFKGIKGKNGELCDIKFPYTYESRSSSSGKRAPSGISDYVSKLGSHKIGQDKTLADFGINSYIMEELGLHIMKAWEDRLYKFKSKRVSFKDYGEINSFGSRYKNGNFAGFTINLKEGFITYNTNGRRGQYADLITLPIDFSREKRGYAAEALKGGVDSLRKLVIVRRCIRGRNKYYLQLTISGEKPQKGRTLGKGNVGIDIGPSTIATSSLYGVHFDELADKCDNIEHELYLLNRKLDRSRRANNPDNYNPDGTIKRGVRLVWKKDKDVKRYASLKQLRKELFRKQAETRKQQHLEMANAMLSQGDTFIVENNPIDAWVRRAKETTKTKTGKNRSKKRYGKSVANHAPAMFVTILENKVKSLGGQFHRIDPGYAATQFDFTNGVFTKHEVSKRSITLSNGRTHQRDMLSAFNLQHARLEAEKAKSRDKEKKVESYDIVQMQADYPIFCRLETAEQERFKDARRNERDALYFVGAFAKKLRHEPQEETVANRHNGGVGRKHCNTLCTENAKITGSGLVRESIERVSEAPEECYHAGDQSIILDGL

SEQ ID NO: 2942 - protein, 524 aa, Unknown
  Description of Unknown: uncultivated organism sequence
  Category: MG91 effectors
  Description: MG91-133 effector
MKEVFVLDLPLRVEKYQSDILNKRFEQLRQLYNYVQGKLLRQYRYFEQMKEYQACKTFKEKKDFFRNHPFHINGILGSNKELLDITFDEYGIKGFVEKLVQKGVGTDMTYADLGFTTLILDHLSAGIWSAWDKMLYDYKARRISFKKYGELDSFSSRRKVVQGKVYFSGMELHLDSMMLSVKMNGKVGKAAKFITLPILHNPKHADYEMWALKGGLDSIKVVKVVRRMVRGRYKYYLQMSIEGEKPLKGRKLGKGNVGIDLGPTTVAVSGENIASIDKLASKCDSIETEKAKLGRKIDRSRRANNPQNFNEDGTIKRGIRLEWNDSKRYKELRVEMAELQRRQAAIRKQQHIDRANELLKEGDTFIVENNQISGWTRKAKETKVNENTGKIRKKKRFGKSVANHAPAMFMTILENKVKSLGGKVVKVDTQNAASQYDFTNNSFTKHELNERSVTLSNGDTHQRDMLAAFNLQHLKYDEQEKKQYDTEAMTKHYERFCELEQAEILRYKNKEKVDDHSTIGAKEL

SEQ ID NO: 2943 - protein, 612 aa, Unknown
  Description of Unknown: uncultivated organism sequence
  Category: MG91 effectors
  Description: MG91-134 effector
MTENFVLTLPLKVEKWQADILDRRYELLRQTYNMVQRKLVRQYIYFSQQKAYKACKGDFSQLREFFASHPFHFKGITSKNGELSDIKFPYTYESRSSGSGKRAPNSISDYVSKLWTHRIGQDKTLADLGINGSILEELGLHIMSAWGKRLYDPKASRISFKDYGDVNSFGSRYHKGNFAGFTINLEEGFITYNANGRRGRYADIIKLPIDFSREKNDYAAYALKGGIESFRKLLIVRRCIRGRNKYYLQLNINGEKPQKGRTLGKGNVGIDIGPSTIATSSLQGVHFDKLADKCDNLEHELYLINRKLDRSRRANNPHNYNEDGTIKRGVRLMWKQDKDVKRYASLKQKRRELYRRQAEIRKLQHLEMANAMLSQGDTFIVENNPIDAWVRRAKETTKTKTGRNRCKKRYGKSVANHAPAMFVTILKNKVQSLGGQFLEVDVRYAATQFDFTNGIKTKHEVSERSITLSNGNTHQRDMLSAFNLQHIRQESIGTEDKDYDIEQMQADYPIFCKLETAEQERFKVARHKERDALYFLGASKKQLRRQPQDESVANRHNGGVGRKHCNTRLGSNNQENAKIRGSGHVRESIERVSQVPDGYHLVGNHPIILDGL

SEQ ID NO: 2944 - protein, 525 aa, Unknown
  Description of Unknown: uncultivated organism sequence
  Category: MG91 effectors
  Description: MG91-135 effector
MNEVFVLELPLQVEKYQADLLNKRYEQLRQLYNYVQGKLLRQYRYFEQMKEFQACKTFKEKKDFFRRHPFHIDGILGSNKELYDITFDEYGINGFVGKLGKKQVSAGVTYADLGITSTLLDRLSLAVWAAWDKMLYDYHAQRVSFRKYGELNIFGSRKKTNGSGKKVFSGMELHLEKMEVAIKLNGKVGKAAKFITLPILHNPKHIDYEMWALKGGFDSVTVLTIVRRLVRSQYKYYVQLTIEGEKPQKGRKLGKGNVGIDLGPTTVAVSGVNVVSIDKLASKCDDIQEEITRLSRRIDRSRRANNPQNFNEDGTIKRGIKLVWNDSNRYKELRRELAELRRKQAAIRKQQHIERANALLKEGDTFIVENNPISSWTTRAKETKVNEKTGKIQKKKRFGKSVANHAPSMFVSILENKVKSLGGDLVKVDTKNAASQYDFTNNSFTKHELKERNVTLSNGDTHQRDMLAAFNLQHLQYDEKDDKQYDTEAMTADYERFCQLEQEEILRYKNKVKKDDRSTIGAEKL

SEQ ID NO: 2945 - protein, 527 aa, Unknown
  Description of Unknown: uncultivated organism sequence
  Category: MG91 effectors
  Description: MG91-136 effector
MPTENFVLELPLRVEKYQADILDKRYEQLRQLYNYVQGKLLRQYRYFEQMKAYQDCNSIKEKREFFSSHPFHINGIYGRNKDLLDITFSKFGIFGLVTKLGQKSVGSGYTYTDCGISSTILAHMSANIWSAWNKMLNDYHTKRISFKRHGELNSFGSGKIDNEYFPGLVLRLEKMELDIKLNGKTGKNAKFITLSILHNPKHADYEMMALKGGFDSVKVITVVRRMVRGRYKYYLQMSIEGEKPKKGRTLGKGTVGIDLGPSTIAVSGNNIASIDKLASKCDNIEKKIQKLNRKIDRSRRANNPDNYNEDGTYKRGVRLSRNESNRYKALRKEKAELQRRQAAIRKLQHIERANELLKEGDTFVVENNQFKGMAKRSKETKVDEKTGKMRSKKRSGKSIANHAPAMFVTILKNKVESLGGRFEIVNTNNAASQYDFTDGSFTKHELSERNITLSNGDTHQRDMLAAFNLEHLKYEAKDPKKYDSEAMHEHYERFCQLEREEIERYKNKEKKDDRSTISASTIVYDKK

SEQ ID NO: 2946 - protein, 528 aa, Unknown
  Description of Unknown: uncultivated organism sequence
  Category: MG91 effectors
  Description: MG91-138 effector
MEEVFVLELPLQVEKYQADILNKRYEQLRQLYNYVQGKLLRQYRYFEQMKEFQVCKTFKEKRDFFRSHPFHINGIYGNDKELLDITFDEYGINGFVGKMGKKLVNANTTYADLGITSTLLDRLSLAVWAAWDKMLYDYRARRVSFKKHGELNIFGSRKKTNGSGKKMFSGMELHLEKMEVSIKLNGKVGKKAKFITLPILHNPKHADYEMWALKGGFDSVKVITVVRRLVRGQYKYYLQLSIEGEKPQKGRTLGKGNVGIDIGPTTVAVSGENIASIDKLASKCDNIQKEITRLARKIDRSRRANNPQNFNEDGTIKRGVRLVWKKDKDCKRYAALKREMAELQRRQAAIRKQQHIDRANALLKEGDAFIVENNQISGWVRKAKETKVNEKTGKIQKKKRFGKSVANHAPAMFVTILENKVKSLGGEVVKVDTQNAASQYDFTNNSFEKHELKERSVTLSNGDTHQRDMLAAFNLQHLKYDDAEKKQYDTEAMAQHYDRFCELEQAEIQRYKNKEKKDDRSTIGAGDL

SEQ ID NO: 2947 - protein, 512 aa, Unknown
  Description of Unknown: uncultivated organism sequence
  Category: MG91 effectors
  Description: MG91-139 effector
MNEVFVLELPLQVEKYQADILNKRYEQLRQLYNYVQGKLLRQYRYFEQMKEYQACKTIKEKRDFFKSHPFQVNESLGGDKSAFEISFNEFSIKGFIEKLVQKSVGANMTYADLGFTTNILDHLGASVWAAWDKKLYDFKAKRISFKKYGELDSFSSRRKVVGGKVYFSGMELHLDTMELAIKMNGKQGNNAKFITLKMQHNPKHAEYEMWALKGGVDSVKVVKVVRRLVRSQYKYYVQLTIEGEKPQKGRTLGMGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISSWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYDEKDTKQYDTEAMTADYERFCQFEQEEILLYNNKLN

SEQ ID NO: 2948 - protein, 514 aa, Unknown
  Description of Unknown: uncultivated organism sequence
  Category: MG91 effectors
  Description: MG91-140 effector
MIVEKYQADILNKRFEQLRQLYNYAQGKLLRQYRYFEQMKEFQACTTFREKKDFLRSHPFHVNGILDRSGDVLNITFDEYGIKGFLEKLIHKPVGSNMTYADLGITTYILDHLSAGIWRAWDKMLYDYHAKRVSFKKYGELDSFSSRRKTSGNKVYFAGMELHLDTMELSVKLNGKQGKDAKFVTMPILHNPKHADYEMWALKGGEDSVKVVKVVRRLVRGQYKYYVQLSIEGEKPQKGRTLGKGTVGIDLGPTTVAVSGENVVSIDKLAAKCDNIQSEITRLARKIDRSRRANNPQNFNEDGTIKRGVRLVWNDSKRYKALRREMAELQRRQAAIRKQQHIDRANELLKEGDTFIVENNQISAWTRKAKETKVNEKTGKIQKKKRFGKSIANHAPSMFVTILENKVNSLGGKVVKVDTQNAASQFDFTDGSFEKHELKERSVTLSNGDTHQRDMLAAFNLQHLKYDDAKKKQYDTDAMGQHYERFCELEREEIERYKKKEKKDDRGTIGAKGL

SEQ ID NO: 2949 - protein, 521 aa, Unknown
  Description of Unknown: uncultivated organism sequence
  Category: MG91 effectors
  Description: MG91-141 effector
MKEVFVLELPLQVEKYQADILNKRYEQLRQLYNYVQGKLLRQYKYFDQMAEFQACKTINEKRIFFRNHPFHIKGILGGDKEPLNITFDEYGINAFVEKLVQKSAGPNMTYADLGFTTYVFDHLSSGIWRAWEKMLYDYRAKRISFKKYGELNSFSSRRKVVRGKIYFSGMELNLERMELSIKLNGKVGKSSKFTTLPILHNPKHADYEMWALKGGLDSVKVLKVVRRLVRGLYKYYLQMSIEGEKPQKGRTLGKGNVGIDLGPTTIAISGQDIVCIDKLAPKCDNIQKEITRLARKIDRSRRANNPQNFNEDGTIKRGARLVWSDSKRYRELRREKAELQRKQAVIRKQQHIDRANALLEEGETFIVENNPISAWTRRAKETKVNEKTGRIQKKKRFGKSVANHAPSMFVSILENKVKSLGGQLIKADPKNAASQFDFTDGSFEKHELNERSVTLSNGDTHQRDMLAAFNLQHLKGDKQYDTEAMERHYERFCELEKKEIMRYKNKEKKDDRSTIAASDFL

SEQ ID NO: 2950 - protein, 524 aa, Unknown
  Description of Unknown: uncultivated organism sequence
  Category: MG91 effectors
  Description: MG91-142 effector
MNEVFVLELPLQVEKYQADILNKRYEQLRQLYNYVQGKLLRQYRYFEQMKEYQACKTIKEKRDFFKSHPFQVNESLGGDKSAFEISFNEFSIKGFIEKLVQKSVGANMTYADLGFTTNILDHLGASVWAAWDKKLYDFKAKRISFKKYGELDSFSSRRKVVGGKVYFSGMELHLDTMELAIKMNCKQGNNAKFITLKMQHNPKHAEYEMWALKGGVDSVKVVKVVRRLVRSQYKYYVQLTIEGEKPQKGRTLGMGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISSWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYDEKDTKQYDTEAMTADYERFCQLEQEEIQRYKNKEKKDDKGTIGAEKL

SEQ ID NO: 2951 - protein, 603 aa, Unknown
  Description of Unknown: uncultivated organism sequence
  Category: MG91 effectors
  Description: MG91-143 effector
MAKENFVLTLPLRVEKRHADILDKRYELLRQMYNMVQQKLVRQYIYFSQQKAYKACENFEQKREFFNTHPFHFKGIKGKNGELCDIKFPYTYESRSSSSGKRPSGGISDYVSKLWSHKVGADKKLVDFGLNGSIMEELGLHVMKAWEDRLYKFKARRVSFEDYGEINSFGCRYHKGNFAGFTINLEEGFITFNANGRRGQFAEIITLPIDFSREKKGYAEEALKGGVDSLRKLIIVRRCIRGRNKYYLQLTISGEKPKKGRTLGMGNVGIDVGPSTIAISSLQGVHFDKLADKCDNIEHKLYLINRKLDRSRRANNPDNYNPDGTIKRGVRLVWKKDKDVKRYASLKQQRKELFRKQAEIRKQQHLEMANAMLSQGDTFIVENNPIDAWVRRAKETKKTKTGKNRCKKRYGKSVANHAPAMFVSILKNKVLSLGGEFREVNPGYAATQFDFTNGVFTKHEVSERSITLSNGRTHQRDMLSAFNLQHICNELKEYNITQMQADYPIFCRLETAEQERFKEARRNERDALYFVGAFAKELRHSPQEETVANRHNGGVGRKHSNTLCTENAKITGSGLVRESIERVAEAPEECYHFDCQPIILDGL

SEQ ID NO: 2952 - protein, 528 aa, Unknown
  Description of Unknown: uncultivated organism sequence
  Category: MG91 effectors
  Description: MG91-144 effector
MNEVFVLELPLQIEKYQADALNKRYEQLRQLYNYVQGKLLRQHRYFEQMKEYQACKKIKEKRFFFRSHPFQINETLKGNKIPFKVSFDEYSIKGYIEKLVQKSVGPNMTYADLGFTTNILDHLGASVWAAWDKKLYDLKAKRISFKKYGELDSFSSRRKVVRGVVYFSGMELHLDSMELAIKMNGKVGKDAKFITLKMLHNPKHADYELWALKGGVDSVKVVKVVRRLVRSQYKYYVQLTIEGEKPQKGRTLGKGNVGIDLGPTTVAVSGVNVVSIDKLASKCDNIQEEITQLSRKIDRSRRANNPQNFNEDGTIKRGIKLVWSDSKRYKELRRELAELRRKQAVIRKQQHIERANALLKEGDTFIVENNPISSWTTRAKETKVNEKTGKIQKKKRFGKSVANHAPSMFVSILENKVKSLGGRFERVSTQNAASQYDFTTDTFKTGEEKHKLNERAITLSNGDTHQRDMLAAFNLQHLKYDEKDAKQYDIEAMTADYERFSQLEQEEILRYKNKVKKDDRGTIGAEKL

SEQ ID NO: 2953 - protein, 484 aa, Unknown
  Description of Unknown: uncultivated organism sequence
  Category: MG91 effectors
  Description: MG91-145 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVINIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARTKATSMTKSGRIRSKKRYGKSIKNRAPSEFLVILKNKLLHYPNGKYYAVPASYACTQFDFTNESFTEHKISERKIVTSDGVQHNRDTLAAFNIKNAIVNETSTKKKKITKSNEFFDIVRMKASYNEFCLMERYLLSI

SEQ ID NO: 2954 - protein, 603 aa, Unknown
  Description of Unknown: uncultivated organism sequence
  Category: MG91 effectors
  Description: MG91-146 effector
MAKENFVLTLPLRVEKRHADILDKRYELLRQMYNMVQQKLVRQYIYFSQQKAYKACENFEQKREFFNTHPFHFKGIKGKNGELCDIKFPYTYESRSSSSGKRPSGGISDYVSKLWSHKVGADKKLVDFGLNGSIMEELGLHVMKAWEDRLYKFKARRVSFKDYGEINSFGCRYHKGNFAGFTINLEEGFITFNANGRRGQFAEIITLPIDFSREKKGYAEEALKGGVDSLRKLIIVRRCIRGRNKYYLQLTISSEKPKKGRTLGMGNVGIDVGPSTIAISSLQGVHFDKLADKCDNIEHKLYLINRKLDRSRRANNPDNYNPDGTIKRGVRLVWKKDKEVKRYASLKQQRKELFRKQAETRKQQHLEMANAMLSQGDTFIVENNPIDAWVRRAKETKKTKTGKNRCKKRYGKSVANHAPAMFVSILKNKVLSLGGEFREVNPGYAATQFDFTNGVFTKHEVSERSITLSNGRTHQRDMLSAFNLQHIGNELKEYNITQMQADYPIFCRLETAEQERFKEARRNERDALYFVGAFAKELRHSPQEETVANRHNGGVGRKHSNTLCTENAKITGSGLVRESIERVSEAPEECYHFDRQPIILDGL

SEQ ID NO: 2955 - protein, 528 aa, Unknown
  Description of Unknown: uncultivated organism sequence
  Category: MG91 effectors
  Description: MG91-147 effector
MKTKEEKKDFVIELPLKVEKWQEHLLSKRCEFLRDIYNYVQNNLLRQFGYFEQMSEWKNCKTKKSKGKFLESHPFTIKGFDTPITFTKYGISNFVSKLCQKKVSREKKYKDFGLNSMTLQQMGLNVWSAWNKKIYDKPRVIKNKETGEIKIKPYEIHFKKRGGLNTIFFGKSNNYFIGLEIDFEHMILYYNINGKQGKNKQSITLPIVFNKPTEYEMFAFKGGYETIKLIKIVRKLIRGRYKFYVQFTIEGEKPQKGRTLGKGVVGIDVGPSTVAVSSLNGVQINTLAEKCDDVYHKCKLLGRKMDRSRRATNPQNYNDDGTIKKGEKLEWNYSKRYLKVRNKRCELLRKQAAIRKLQHNIDTNELLRLGDTFVVEKNPISAWQQRGKKIKINKRGRIQTNKRFGKSIANHAPAMFITILENKVKSLGGEFKRVPIENGASSFDFTNSEFVKHGLSERKITLSNGNVHQRDMIAAYNLQHLNYNSEELKDYNIEDMKKDYPIFCELEKMEIDKYISGQKKSHKSTVGY

SEQ ID NO: 2956 - protein, 524 aa, Unknown
  Description of Unknown: uncultivated organism sequence
  Category: MG91 effectors
  Description: MG91-148 effector
MNEVFVLELPLQVEKYQADILNKRYEQLRQLYNYVQGKLLRQYRYFEQMKEYQACKTIKEKRDFFKSHPFQVNESLGGDKSAFEISFNEFSIKGFIEKLVQKSVGANMTYADFGFTTNILDHLGASVWAAWDKKLYDFKAKRISFKKYGELDSFSSRRKVVGGKVYFSGMELHLDTMELAIKMNGKQGNNAKFITLKMQHNPKHAEYEMWALKGGVDSVKVVKVVRRLVRSQYKYYVQLTIEGEKPQKGRTLGMGNVGIDLGPTTVAVSGENVVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISGWATRAKETKVNQKTGKIQKKKRFGKSIANHAPSMFVSILENKVKSLGGEVVKVDTKNAASQYDFTNGSFTKHELKERNVTLSNGDTHQRDMFAAFNLQHLKYDETEAKQYDTKAMAADYERFCQLEQEEIQRYKNKEKKDDRSTIGAEKL

SEQ ID NO: 2957 - protein, 557 aa, Unknown
  Description of Unknown: uncultivated organism sequence
  Category: MG91 effectors
  Description: MG91-149 effector
MVTQKCRPLTGVGAESRAGFQVMVTQKCWLIEIMEEVFVLELPLQVEKYQADILNKRYEQLRQLYNYVQGKLLRQYRYFEQMTEFQACKKIKEKRDFFRSHPFQINETLKGNNTPFKVSFDEYSIKGFVEKLVQKSVGPNMTYADLGFTTYILDHLGTSVWSAWNKKLYDFKAKHISFKKHGELDSFSSRRKVVRGVVYFSGMELHLDTMELSIKLNGKVGKEAKFITMSILHNPKHAEYEMWALKGGLESVKVVKVVRRLVRGQYKYYAQLTIEGEKPQKGRTLGKGNVGIDIGPTTVAVSGENIASIDKLASKCDNIQEEITRLARKIDRSRRANNPENFNEDGTIKRGVRLVWNDSKHYKELRRELAELQRRQAAIRKQQHIDRANELLKEGDTFIVENNQISGWTRKAKETKVNEKTGKIQKKKRFGKSIANHAPAMFVTILENKVKSLGGEVVKVDTQNAASQYDFTNNSFEKHELKERSLILSNGDTHQRDMLAAFNLQHLKYDAPEKKQYDTEAMTQHYDRFCELEQAEIQRYKNKEKKDDRSTIGAGDL

SEQ ID NO: 2958 - protein, 524 aa, Unknown
  Description of Unknown: uncultivated organism sequence
  Category: MG91 effectors
  Description: MG91-150 effector
MEEVFVLELPLQVEKYQADILNKRYEQLRQLYNYVQGKLLRQYRYFEQMTEFQACKKIKEKRDFFRSHPFQINETLKGNNTPFKVSFDEYSIKGFVEKLVQKSVGPNMTYADLGFTTYILDHLGTSVWSAWNKKLYDFKAKHISFKKHGELDSFSSRRKVVRGVVYFSGMELHLDTMELSIKLNGKVGKEAKFITMSILHNPKHAEYEMWALKGGLESVKVVKVVRRLVRGQYKYYAQLTIEGEKPQKGRTLGKGNVGIDIGPTTVAVSGENIASIDKLASKCDNIQEEITRLARKIDRSRRANNPENFNEDGTIKRGVRLVWNDSKHYKELRRELAELQRRQAAIRKQQHIDRANELLKEGDTFIVENNQISGWTRKAKETKVNEKTGKIQKKKRFGKSIANHAPAMFVTILENKVKSLGGEVVKVDTQNAASQYDFTNNSFEKHELKERSVILSNGDTHQRDMLAAFNLQHLKYDAPEKKQYDTEAMTQHYDRFCELEQAEIQRYKNKEKKDDRSTIGAGDL

SEQ ID NO: 2959 - protein, 527 aa, Unknown
  Description of Unknown: uncultivated organism sequence
  Category: MG91 effectors
  Description: MG91-151 effector
MNEVFVLELPLQVEKYQADILDKRYEQLRQLYNYVQGKLFRQYRYFEQMKEYQACEKINEKKDFFRTHPFLINETLKGIKTPFMVSFDEYSIKGFIEKLAQKQVGPNMTFADLGFTTYILDHLGASVWAAWDKKLYDFKAKRISFKKYGELDSFSSRRKVVRGVVYFSGMELHLDTMELAIKMNGKVGKEAKFITLKMLHNPKHADYEMWALKGGVEIVKVVKVVRRLVRSQYKYYVQLTIEGEKPQKGRTLGKGNVGIDLGPTTVAVCGENVVSIDKLASKCDNIQEKITRLSRKIDRSRRANNPQNFNEDGTIKRGIKLVWKKDKDLKRYSKLKRELVELRRKQTAIRKQQHIDRANALLKEGDTFIVENNQISSWTMRAKETKVNEKTGRIQKKKRFGKSVANHAPSMFINILENKVKSLGGKVVKVDTKNAASQYDFTDGSFTKHELKERNVTLSNGDTHQRDMLAAFNLQHLKYNEKETKQYDTEAMAADYERFCQLEQEEIQRYKNKEKKDDRGTIGAEKL

SEQ ID NO: 2960 - protein, 528 aa, Unknown
  Description of Unknown: uncultivated organism sequence
  Category: MG91 effectors
  Description: MG91-152 effector
MNEVFVLELPLQIEKYQADALNKRYEQLRQLYNYVQGKLLRQHRYFEQMKEYQACKKIKEKRIFFRSHPFQINETLKGNKIPFKVSFDEYSIKGYIEKLVQKSVGPNMTYADLGFTTNILDHLGASVWAAWDKKLYDLKAKRISFKKYGELDSFSSRRKVVRGVVYFSGMELHLDSMELAIKMNGKVGKDAKFITLKMLHNPKHADYELWALKGGVDSVKVVKVVRRLVRSQYKYYVQLTIEGEKPQKGRTLGKGNVGIDLGPTTVAVSGVNVVSIDKLASKCDNIQEEITQLSRKIDRSRRANNPQNFNEDGTIKRGIKLVWSDSKRYKELRRELAELRRKQAVIRKQQHIERANALLKEGDTFIVENNPISSWTTRAKETKVNEKTGKIQKKKRFGKSVANHAPSMFVSILENKVKSLGGRFERVSTQNAASQYDFTTDTFKTGEEKHKLNERAITLSNGDTHQRDMLAAFNLQHLKYDEKDAKQYDTEAMTADYERFCQLEQEEILRYKNKVKKDDRGTIGAEKL

SEQ ID NO: 2961 - protein, 527 aa, Unknown
  Description of Unknown: uncultivated organism sequence
  Category: MG91 effectors
  Description: MG91-153 effector
MTEVFVLELPLQIEKYQADLLNKRYEQLRQLYNYVQGKLLRQYRYFEQMKEYQACKTIKEKRDFFRSHPFQITETLKGNKTLFTVSFEEYSIKGFVEKLAQKPVGSNMTYADLGFTTYILDHLGASIWAAWDKKLYDFKAKRISFKKYGELDSFSSRRKVVRGIVYFSGMELHLDTMELAIKMNGKVGKEAKFITLKILHNPKHAEYEMWALKGGVDSVKVVKVVRRLVRSQYKYYVQLTIEGEKPQKGRTLGKGNVGIDLGPTTVAVSGMNIVSIDKLASKCDNIQPKITRLSRKLDRSRRANNPDNYNEDGTIKRGVKLVWKKEKDLKRYSKLKRELAELRRKQAAIRKQQHIDRANALLKEGDTFIVENNQISGWTTRAKETKVNEKTGKIQKKKRFGKSVANHAPSMFVSILENKVKSLGGEVVKVDTKNAASQYDFTNNSFTKHELKERNVTLSNGDTHQRDMLAAFNLQHLKLDEAKTEQYDTAAMAADYNLFCQLEQEEIQRYKNKEKKDDRSTIGADKL

SEQ ID NO: 2962 - protein, 326 aa, Unknown
  Description of Unknown: uncultivated organism sequence
  Category: MG91 effectors
  Description: MG91-154 effector
MNEVFVLELPLMVEKYQADILNKRYEQLRQLYNYVQGKLLRQYRYFEQMADYQVCKTIREKRDFLKNHPFNINGVLDRRGKLLDITFDEYGIQGFVEKMIHKSVGNNISYADLGLNTLILDYLAASIWRAWDKKLYDLNAKRISFKKHGELDSFSSRRKVVNGTARFFGLELYLDKMELAVKVNGKQGKNAKFITLKIQHNPKHVDYEMWALKGGVDSVKVVKVVRRLVRSQYKYYVQLTIEGEKPQKGRTLGKGNVGIDLGPTTVAVSGENIVCIDKLASKCDNIQDEITRLSRKIDRSRRANNPQNFNENATIKRGIRLVWNDS

SEQ ID NO: 2963 - protein, 525 aa, Unknown
  Description of Unknown: uncultivated organism sequence
  Category: MG91 effectors
  Description: MG91-155 effector
MTEVFVLELPLQVEKYQADILNKRYEQLRQLYNYVQGKLLKQYRYFEQTKKFRACKTIKEKRDFFKKHPFHINGILGSNKELLDITFDEYGISGFVTKLGMKNIGSNISYTDVGINSSILAKLSSNIWSSWIKFLYDSKAKRIAFKKYGELNSFGCGKKTNGSRKKIFSGMELNLERMELSIKLNGKVGKSAKFIILPILHNPKHEDYEMMALKGGFDSVKVITVVRRMVRGHYKYYLQMSIEGEKPQKGRTLGKGNVGIDLGPTTVAVSGENIASIDKLAPKCDNIEAAKVKLSRKIDRSRRANNPLNFNKDGTVKRGVRLVWNDSNRYKALRCEMAELHRKQAAIRKQQHIDRANALLKEGDTFIVENNQISGWTRRAKETKVDETTGKIRKKKRFGKSVANHAPSMFVTILENKVKSLGGQVVKVDTQNAASQYDFTNDSFEKHELKERSVTLSNGDVHQRDMLAAFNLQHLKYDETEKKKYNRKAMEQHYERFCELEKEEIRRYKEKEKADDRSTIGTSNF

SEQ ID NO: 2964 - protein, 405 aa, Unknown
  Description of Unknown: uncultivated organism sequence
  Category: MG91 effectors
  Description: MG91-156 effector
MPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHREAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCANIEKEIHIPKVAVEQLEGAKQFLTDAGYVVLKSTSGRDQRDPRLASEPKAMTPEMARQKILRGAGDSHLPTDQELGQIRAGGKVSTWSKETFPLQRGVV

SEQ ID NO: 2965 - protein, 530 aa, Unknown
  Description of Unknown: uncultivated organism sequence
  Category: MG91 effectors
  Description: MG91-157 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLASEPKAMTPEMARQKILRGAGDSHLPTDQALGRIRAGGKVSTWSKETFPLQRGVV

SEQ ID NO: 2966 - protein, 528 aa, Unknown
  Description of Unknown: uncultivated organism sequence
  Category: MG91 effectors
  Description: MG91-158 effector
MKEIFVLELPLKVEKYQADILDKRYEQLRQLYNYVQGKLLRQYRYFEQMKEFQACKKIKEKRDFLRNHPFHVNGIYGLNKELLDISFDEYGILGWVTKLGQRSISLGRTYSDMGITARMLANLSDNIWSAWKKKLYDYHADRISFKKHGCLNTFGCTKSVTKHGGKVKEYFSGMVLHLERMELDIKTNGRTRKTATFITLPILHNPKHADYEMMALAGGVSSIKVLTVVRRMVRGRYKYYLQMSIEGEKPQKGRTLGKGNVGIDLGPTTVAVSGENVVSIDKLASKCDNIKSEIGKLNRKIDRSRRANNPQNFNEDGTIKRGVRLVWNDSKRYKALLKEKAEMQRKQAAIRKQQHIDRANALLKEGDTFIVENNKISGWTARAKETKVNEKTGKIQKKKRFGKSVANHAPAMFVTILENKVKSLGGQVVKVDTQNAASQYDFTNDTFNKHELKERSITLSNGDTHQRDMLSAFNLQHLKYDEKELKQYDKEGMKDHYKQFCKMEKEEIERYKNKEKKDDRSTIGAEGL

SEQ ID NO: 2967 - protein, 601 aa, Unknown
  Description of Unknown: uncultivated organism sequence
  Category: MG91 effectors
  Description: MG91-159 effector
MIEEFVLTLPLKVELWQADILNKRYEHLRRIYNMVQRKLLRNYIYLSQQDAYRQCKDNNEKRDFWENHPVTIKEFCDKNGNPAIVKFPYTLSRRSKNSGKKASNGISDFVPKFKNHNIGSGLTYGALGINASILEELGLRIQQAWEKRLYNPKSKHISFKEEGDINTFGCREKRGFSGFVLDLSHMMLLVNINGRQHQLAQYLNLPINPNKELTEYEMYALKGGLSSVRKIIISREYIRGRYKYYVQLTIKGEKPQKNRTLGKGTVGIDVGPSTVAVSSLQGVSLDKLADKCDDIERDLWRINRKMDRSKRATNPDFFNKDKTYSKRKKDERRKWTFSNRYKRLKLERRELYRKQAAIRKQQHIEMANALLSQGDEFIVENNPIDSWAKRAKETKKGKNGKNRCKRRFGKSIAHHAPAMFVSILQNKVRSLGGSFREVEIKNAATQFDFTNGEFTKHELNERTVTLSNGRTHQRDMLAAFNLQHLKEEVKDYDIEQMDVDYPLFCKLEEKGIAQFKENRHLDRDVAYFVGASHKTLKFSSANRHNGGVGRKNCNHHSGGRDVAKTGNKSSIMKNCESLEPVSVLPNEYHHSNHQHLKIDGL

SEQ ID NO: 2968 - protein, 483 aa, Unknown
  Description of Unknown: uncultivated organism sequence
  Category: MG91 effectors
  Description: MG91-160 effector
MAHKENQKAFVVTFPLRTEKWQEDRIDKMMRMLTTFYNDRQRKLVRRYIYLLHSKAYKEAKGKGVVAFKNYMKEHGFSQYGLDAFFKADTKGALYQCGLNSMFLQYLSQCAWSAWDKKLFGKGDFVKTDKVVNIFCSRNMKGRFCGFDYDLSTFTISIKSTCTKKIICTIPFVVNKKSDYELFALSQKTCRIGIVRKLIRSKSKYYVQFTFDGVPYNKGRNIGTGIVGIDPGPSKIAIVGDKKVELRKLAPNIIEDERKTARLKRKFDRSRRATNPHMYKEDGTNIKGQRQICFSKAYNETMKQLAEAQRKLAAKRKIAHNKLANTLLEYGDTFKVEANSYKSMQARAKATSMTKSGRIRSKKRYGKSIKNRAPSEFLVILKNKLLRYPKGKYYDVPASYACTQFDFTNESFTQHKISERKIVTSDGIQHNRDTLAAFNIKNAIVNDISKKKKITKSKEFFDIVRMKASYNEFCLMERYLLSV

SEQ ID NO: 2969 - protein, 602 aa, Unknown
  Description of Unknown: uncultivated organism sequence
  Category: MG91 effectors
  Description: MG91-161 effector
MIEEFVLTLPLKVETWQADILNNRYEHLRHIYNMVQRKLLRRYIYLSQQNEYRQCKDNDEKRTFWENHPITFKDFCDKNGNPAIVKFPYTYSHRSKDSGKKASNGISDFVPKFKNRNIGGGLTYGSLGINASILENLGLRIEQAWKKRLYDPKSKHISFKEEGDLNTFGCREKDGFSGFVLDLQKMTLSFNTNGRQGKSAKFIHFTINAGKELTEYEMYALKGGIGSIRKIVVSREYVRGRYKYYVQLTIKGEKPQKNRTLGKGTVGIDVGPSTVAVSSLQGVSLDKLADKCDDIERDLWRINRKMDRSKRATNPNFFNKDKTYSKRKKDERRKWTFSNRYKRLKLERRELYRKQAAIRKQQHIEMANALLSQGDEFIVENNPIDSWAKRAKETKKGKNGKNRCKRRFGKSIAHHAPAMFVSILQNKVRSLGGSFREVEIKNAATQFDFTNGEFTKHELNERTVTLSNGRTHQRDMLAAFNLQHLKEEVKDYDIEQMDVDYPFFCKLEEKGIAQFKENRHLDRDIAYFVGASHKTLKFSSANRHNGGVGRKNCNHHAGSKRNVAETGNKSSSKKNCESMETVSLVPNEYHHSNHQHLRLDGL

SEQ ID NO: 2970 - protein, 537 aa, Unknown
  Description of Unknown: uncultivated organism sequence
  Category: MG91 effectors
  Description: MG91-162 effector
MSTKSFIISLPIITGDQDRRRLQKSFSFGCNLQNAVMGGGWDRVLKMRATAEWQTARAMPKSSERTKAFRDLRVRFRLSENDFHADVAKHRKASGRGHLLGINEGQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKNHKSLKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADLEKQTYAPERICEAVLAGVTAWLDAGVVVIQAREGITEREFGRFRRRGIPSLTVQGLRQQGFRGRSDSKSGATPRRKASTVSKPSHLSGEVV

SEQ ID NO: 2971 - protein, 518 aa, Unknown
  Description of Unknown: uncultivated organism sequence
  Category: MG91 effectors
  Description: MG91-163 effector
MNNKKEDDIFVLELPLSVEKWQSDLLDRRYEYLRQIYNYAQRKLIRQYIYLVQTEEYKKCRTKKDKSSFFGNHEFWFNGIKCPITFTEFGIKKYVTKLCKLKVSSGMTYKDFGLNSSHLETLGANMWAAWDKKIYGKGERINIKRYGCLNTFSVRCKSGYFGGLKVILDGNEIYLFLDMNGKKGEKEKKEIKLTVKIGKMTEYEMQALRNGIENIRMVTIARKLVRGKYKYYVQFAIKDEKPKKGRKLGKGSVGIDVGPSTVAVSSLHGVEINTLAEKCDDIHRKVRLIQRKMDRSSRASNPQNYNEDGTIKKVRGQKLKWVRSKNYVRLRNEKRELMRKQAAIRKLSHNIDTNKLLELGDTFVVEDNPISSWTKRASGIRKGKNGKNLSNKRYGKSVANHAPAAYVEILKNKVESLGGKFIKVDTKNGASGYDFTTGEYTKHGVEKRKVTLSNGNVHQRDMLAAFNLQHLNYEDGELKSYNVEEMEKDYPIFCKLEKEEIKRYTSGQKTSHKSTVGY

SEQ ID NO: 2972 - protein, 459 aa, Unknown
  Description of Unknown: uncultivated organism sequence
  Category: MG91 effectors
  Description: MG91-164 effector
MKTAATTSFVAELPLRVGADVEALLERTFGFARNLYNATLGTVLGRYQALRESQAWQLARTLPKKEAGEEFNRLMRQADLTKSGFEKILNKHRHSSGRAEQLDCNSGQKIADRLWDAFMRYRTRQGGKPRFKSERRGIHSIEGKTNTTGFRWKAQEGCVRWGKRRLPVIVNKQDDWLMRALADPIDPSKRRRVKYCRILWRKFGGRKRWFVQLVCEGVSPIKHILAPTERKAGIDPSTKSMTVACACGAVEKVDLATPLKKADREIRLLQRKLDRSRRATNKDNYNEDKTVKKGASGWVYSKHYEKIRTVYADAQRRAAAHRKCVCNEAVNWVLGQAGCIIVEKNNFKAFQKSRYGKSISKAAPGQFVTNLNVKAVSAGLKVFIVPPYELRPSQHDIETGQYVRHELCERWVKLGQSGLWLNRNALAALNLLWLDDAATRYSAARRSERTLGSRETGWA

SEQ ID NO: 2973 - protein, 484 aa, Unknown
  Description of Unknown: uncultivated organism sequence
  Category: MG91 effectors
  Description: MG91-165 effector
MAHKENQKAFVVAFPLRSEKWQEDRIDKIMRMLTTFYNDRQRKLVRRYIYLSHSKAYKEAKGKSVVAFKNYMKENGFSQYGLDAFFKADTKGALYQCGLNSMFLQYLSQCAWSAWDKKLFGNGDFVKTTKVVNIFCSRNQKGKFCGFDYDLSTFTIRIKSTCTKKIICTIPFIVNKKSDYELFALSQKICRIGIVRKLIRSKYKYYVQFTFDGIPYNKGRNIGTGIVGIDPGPSKIAIVGDNKVEILKLAPNIEEDERKTARLKRKLDRSRRATNPHMYKEDGTTIKGQRQTCFSKAYNETRKQLADAQRKLAAKRKIAHNELANTLLEYGDTFKVEANSYKSMQARTKATSVTKSGRIRSKKRYGKSIKNRAPSEFLVILKNKLLYYPKGKYYDVPASYACTQFDFTNESFTEHKISERKIVTSDGIQHNRDTLAAFNIKNSIVNDTSTKKKKITKSKEFFDIKKMKASYNEFCIMEHHLLSV

SEQ ID NO: 2974 - protein, 530 aa, Unknown
  Description of Unknown: uncultivated organism sequence
  Category: MG91 effectors
  Description: MG91-166 effector
MKSSSIIVSYEITLPQRIYLHLDRLFSVFRRSVRNFIDMFWNENTLGLLNQKGHTCSILKEIVQRPQNLPSRVFRNALEITGQILRSQIERKRLFDAFMQYPCLVLYNEREIAKRLNTSTWFALNVKRQILKLIRNGERRDYFSLAKPSFSGSVVITSADDSLEKGQFKRLRIEKNKLIFELKVPVGNAWDWIKVEKFVPDRLRKALKNAKEIKAPLIKKVDLKSGFSIYRLVIPLEIQTKVKDKVERVFALDLSPSEKRIGVGVVVDSEGYSKPVFFNAYKMFKKLERLYREISNLEKKIDHIADDLHSTFKREHKEKLYQRLRHLYQEQKLRWRKFKDLRKQVLESFTNLVILHAKAYNCDAIAIEDLKFKDLPDWKNKRLRRIFSIWFYSKFEDRLRHKAQREGIKVLSVNPFNTSQVCHECGSKSKANRLEFACESCGKHFDRDYNASVNIGLKALTLACKTKSKPYKGKDIPARFPSLQVLTRYKFKSLLTLLSLSKLVAYLRLVETSYLKLKSLLKYVSADKYG

SEQ ID NO: 2975 - protein, 530 aa, Unknown
  Description of Unknown: uncultivated organism sequence
  Category: MG91 effectors
  Description: MG91-167 effector
MKSSSIIVSYEITLPQRIYLHLDRLFSVFRRSVRNFIDMFWNENTLGLLNQKGHTCSILKEIVQRPQNLPSRVFRNALEITGQILRSQIERKRLFDAFMQYPCLVLYNEREIAKRLNTSTWFALNVKRQILKLIRNGERRDYFSLAKPSFSGSVVITSADDSLEKGQFKRLRIEKNKLIFELKVPVGNAWDWIKVEKFVPDRLRKALKNAKEIKAPLIKKVDLKSGFSIYRLVIPLEIQTKVKDKVERVFALDLSPSEKRIGVGVVVDSEGYSKPVFFNAYKMFKKLERLYREISNLEKKIDHIADDLHSTFKREHKEKLYQRLRHLYQEQKLRWRKFKDLRKQVLESFTNLVILHAKAYNCDAIAIEDLKFKDLPDWKNKRLRRIFSIWFYSKFEDRLRHKAQREGIKVLSVNPFNTSQVCHECGSKSKANRLEFACESCGKHFDRDYNASVNIGLKALTLACKTKSKPYKGKDIPARFPSLQVLTRYKFKSLLTLLSLSKLVAYLRLVETSYLKLKSLLKYVSADKHG

SEQ ID NO: 2976 - protein, 633 aa, Unknown
  Description of Unknown: uncultivated organism sequence
  Category: MG91 effectors
  Description: MG91-168 effector
MLTKDLKQEALKRGFLHSGVNDSIEAYRTRNLTIYDFVCEESAVVRVCISKQHAGIYDVLSNIWKDCMLENYLEDPNQFANYMLSECAKKLLKTDSLFFDSKASFAIDAQIRKAKNWKKINQKENREKEIKKIMAGTNKPVPSGFKIFSEKLLCSAKRIMYSAKEKSLYCPECGNTFQLPDVPKKGSLHTCPACGYSTKVSSAQYLNDIHWSCIVQAAGKRSIIRYFCNELFIEYGKCSTILYEKYRTIVEEDGSMVPLMQTSEGWKDYKGKNYSYFYTVPKREVPNDMYLYGTVEALMKMPALKNSMLDVWVKQHIGADKKLCSEYLVENYIKVYAQTTIYEKLLKHGLNKIAHEAAFYYDSSFHKNEEKVDKFLNLTKGNLDRLREFIPDPSGSNVSAMRYLEKYNVYLKDDELKTFLRLEVSDNMKEQIVKFCKCKKVTLYKINKYVTENANADWSSYFDYIGWTEELDYKKSDSVYYPKKFFKTHDRVFKELEEKKDAIQRKKDKEISKKIADLWEQRMQIPQYYYENNDLFVMMPHGTSDLKKEGRSLNHCVAGYKEFVAEEKTQIFFIRKKAAPQKSFYTLEIKNHDIEQCHGKNNVNMTEEIRAFAYGFLNQLKTIKEKPAVRAAA

SEQ ID NO: 2977 - protein, 484 aa, Unknown
  Description of Unknown: uncultivated organism sequence
  Category: MG91 effectors
  Description: MG91-169 effector
MAHKENQKAFVVTFPLHTEKWQEDRIDKMMRMLTTFYNDRQRKLVRRYIYLSHSKAYKEAKDKGVVAFKNYMKEHGFSQYGLDAFFKADTKGALYQCGLNSMFLQYLSQCAWSAWDKKLFGKGDFVKTDKVVNIFCSRNMKGRFCGFDYDLSTFTIRIKSTCTKKIICTIPFVVNKNSEYELYALSQKICRIGIVRKLIRSKYKYYVQFTFDGVPYNKGRNIGTGIVGIDPGPSKIAIVSDEKVEIAKLAPGIEEDERKTARLKRKLDRSRRATNPHMYKENGTNIKGQRQICFSKSYNETRKQLADAQRKLAAKRKIAHNELANTLLEYGDTFKVEANSYKSMQARTKATSMTKSGRIRSKKRYGKSIKNRAPSELLVILKNKLLYYPKGKYYDVPSSYACTQFDFTNESFTEHKISERRIVTSDGIQHNRDTLAAFNIKNTIVNDTSTKKKKVTKSKEFFDIVKMKASYNEFCLMERYLLSV

SEQ ID NO: 2978 - protein, 511 aa, Unknown
  Description of Unknown: uncultivated organism sequence
  Category: MG91 effectors
  Description: MG91-170 effector
MPSQATTPSFVVELQLRIGSDVEQVLERTFRLAQCLHNATLCTVLKRDGELRASDAWRAAKAMPKGKERTAEFKRLMESAGLTKNGFEKILLDHLRKSGRRDQIDSNTEQKIADRLWDAYQRWRYENGGKPRYKGKRRGLHSLEGKTNKSGIRWKPDNQCIEWLGCRMLARVDKSDELLMRALADPQDPQKPRKVKYCRVLWRNINKRKRWFVQLVCEGTSPVKHVFAPADIKAGIDPSLRSMTCFVEDGTVEKIDISAGLAKSARTIRNVQRRVERKRRSNNPKNYDEKGRVKKGPLKWNISKKQRDLEAKLAECHRKAAAHRKNKAGELANWLLGRAGCIHVEKNQFKAFQRSGFGRSILKGAPRQCITMLKAKAASAGLKVFEVSPRKLRPSQHDIETGEFIKHGLSERWIKLGESGLWINRDAMAALNLLWVDESGENYLPSDDCKKHWEAVKCVLLDAGWLVQLEARDEASEIFLRRFRRKDRPALTVGELRQKRNRGRSDDSSAA

SEQ ID NO: 2979 - protein, 530 aa, Unknown
  Description of Unknown: uncultivated organism sequence
  Category: MG91 effectors
  Description: MG91-171 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGTKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLASEPKAMTPEMARQKILRGAGDSHLPTDQALGRIRAGGKVSTWSKETFPLQRGVV

SEQ ID NO: 2980 - protein, 530 aa, Unknown
  Description of Unknown: uncultivated organism sequence
  Category: MG91 effectors
  Description: MG91-172 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMYRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLASEPKAMTPEMARQKILRGAGDSHLPTDQALGRIRAGGKVSTWSKETFPLQRGVV

SEQ ID NO: 2981 - protein, 723 aa, Unknown
  Description of Unknown: uncultivated organism sequence
  Category: MG91 effectors
  Description: MG91-173 effector
MAEEKEMRSYNIRINPDADAIKVIERDMKLMEQLYGFIIYKIESHIQQLRDETEYGEYDSNYKEYCRLMAEAEQKKRQCEVLRDAKKRKNIEDPELDSQYKELSAEIIKLDKHRKEWCRKCCEFFKNNKKALCHFVFESRRKVIRLKSDMVTPTENSGFILHHGVNGELYYIYDKTYYMMVEDSIRKANKGDGYSALVCECGVVTKRVSLNEDKTFKDKVYDGVAVLTDDGEIIMPYEYLRIDKLNKNNAHSFSILFVGEYVYSLNKNPKTKKSQKTSMAYKDFGFTSTDFFENIGNRLTLSYADFPKLLSQKHRKNDFMTIMCGYQSKLMDIMCDESGGYFVRMVTHSYGRGKKKYVDIPVLVSHRNKNRIGTERDMDTKVLEKKLKLLETGKTNVIGISKDVIREKSRYYVNIFLEHTGSLGLEYNENSLNQELGVGSVGVDPNMHQIAVYSDSLKKSTIFSLETIRGGIFKQKIYDCYSKLNSLQTKMSRCMDENNSGAKDENGNFIKGKKLFKSKRYLAMKKEVGELHRRIAELKETANIFIAHELLSYGNVFYIEDPRSAEKKRRMQGVVYDVKGRVVKNRKFSRSIQKFSISGMIYKALDVIESRGGKVYWINNKSAATAYVPKGDNVSHGMGERVFNWLGYKVQRDMKSGYVLSGCKELEQTKETYLNKPIYKVVSYDDERLLNDVDVFAESVKEEMERCRDLNVEDKTIGVEKYF

SEQ ID NO: 2982 - protein, 1129 aa, Unknown
  Description of Unknown: uncultivated organism sequence
  Category: MG91 effectors
  Description: MG91-174 effector
MKKLLSINLGITSIGYSVLNELDNDKYSLIDYGVNMFDTPYDKDGNSKKLIHSQIKSTKKLYELRKERKKNLSKLFEDFGFAKKEDFLNQEKENLFINKWGLRAKKAFEEKLTFQELFSILYLIAKHRGYKSLDTDDLLEEFCEKLGLNQEKKKDNGKDNEKGKIKQALKTIETLKLQFPQKTIPQIIYEVEIQKENPTFRNHDNYNYMIRREYINEEIKALVLSQEKFGLFDKNFDSKAFIEKLIETIDDQKESSNDLSLFGNCEYLKNEKVAHQYSLLGDIYKMYQSVANITFNSNPTIKISKEQIKLIANDFFDKLKNGKNISDIKYKEIRKILKLSDDFKIFNKEDSYKSKDKTQENSITKFHFVNNLSKFDKDFIKSILEKSNKYDILKEVFDVLRDEKQPKPIYDKLNNIFSKYDLIKNESIKNNTILELIKNKTGSSLSISHQAMINIIPYFEDGSTIDEIKQKLNLSREEDYLSYKKGIKYLSVAQFENNNNLPINNHPVKYVVSAALRLIKHLHVTYGAFDEIRVESTRELSLNDESKRNIDKVNRENEAKITAILENIEYQQIAQTYGKKLEKYARKILIWDEQERFDIYNGKSIGFGDIFSNSVDIDHIVPQSLGGLSVKHNLVLVHRDTNLQKLNQLPLNFIADKQGFIDRIEYLFKEHKISWKKRKNLLATNLDDTYKDTFESKSLRATSYIEALTAQILKSYYPFPNQTKNSMEVRHIQGRTTSNIRKLLKVKTKIRNTNIHHAIDAILIGLTNQSWLQELSNTFRENMGVIDDVARQNIKKVIPLIEGIEPKELIEMIENNYNAYGEDSIFYKDIFGKTKAVNFWVSKKPMVSKIHKDTIYSKKPNDFYTVKENILNQFIALKVNNDTKANKFYEDFKKNILEKMYVYKTNPNDVICKIVQNRAYDIKELLTSFETIDKKDKEALSEAKQKLDTLIHNPLLDNNNKPIRKVKFYQTNLTGFNIRGGLATKEKTFIGFKASLKNDKLFYERIDVANKNNIKDNDFLIIRNNLICINFKNKNLLGFVESFDENTNKIRMYDSRYPKRLENQPERFKVASGKGRKEFGIAGAIGIIKLNLDILGNINSYQIIGTIQNELYSFFKKLKNDKGNLPINT

SEQ ID NO: 2983 - protein, 1350 aa, Unknown
  Description of Unknown: uncultivated organism sequence
  Category: MG91 effectors
  Description: MG91-175 effector
MSNINYYLGLDLGTDSVGWAVTDPNYKLLRAKGKDLWGIREFEAAKTSAERRSYRTSRRRKQRKTVRIGLLKEYFKDEIDKVDSNFYESLENSFFKKEDKPEGARSKNLLFNDKDFKDSDYYEKYPTIFHLRSELIHSKEPHDVRLVYLAILNIFKHRGHFLNENLSTSSTSVSIEEVYSELRNLLIDKTDIKLPDKIDEKNFEEVMCDRGLSRSEKQKRILDQLEISSKDKDKVEIIKAICGLKVDAKKIFPIESDEKLAFCFAEARFEEIQGDLENSLGDDYFSIIMLMKQIYDTCAWDTVIKGFEYLSDARIDSYNKHARDLKILKKVLKKKGQDAYDRFFRTEEDGTYGDYVGSNVNDGKVGRRGGNKHTRDDFYSAVKNEIKGVDDLDVEVIQSDIDNGTFMPLQLSRDNGIIPYQAHYKELDAILENAQKYLPFLSEKNAESQMTISEMIKKIFAFKIPYFVGPVTEESKKNNGNGWVVRKEEGPVLPWNIDSKIDMEKTSEEFINRLIRKCTYISGEKVLPKNSLIYERYMVLNAINTIAIDGERISVELKQQIYNDLFSKGTVVTKEKLAKYLSGRGLINSKNQISGMDDRINNTLSNYNKFYRIFGNEIKKDSTQNMIEEIIRLCTIFGDSKKDLKNKLEKEYGDKLSKEQLKSILGIKCKDWGKLSKAFIELQGADKSTGEIFSLINALWNTSFNMMELINSDEYTFKEELNKKMETGLKPVNEMVYEDLDGMYLSAPVRRMVWQTLLVIRELEKVLGCPPKKVFVEMTRGDGEKVRTKSRKDVFSELYKKIKEDTPKWLEIIGKAEENGTIRSKKMYLYLRQKGKDMYTGKPISLDDLFNDNLYDIDHIYPQSLTKDDNLDNNMVLVNKSDNSNKQNVYPLSEDIRNKCKGLWKELHDQGFINDEKYSRLTGRSPLTDEQLEEFIARQLVETSQGTKAVAQIMSGAMPESKVVYSKARVVSDFRNKYELLKSRLVNDFHHANDAYLNIVVGNAYLVKFTDNPKRYIKEEYNKDKEKYRYNLAKFFENDVIRGKEVAWVSTKENGEIGTIATVKKMMSKNTPLLTRMNFVGHGGIADQTLYGTDKAKEDGYLPIKGKDSKFKVSKYGGYNKASTAYFFLVESEVKGKKQRTLETVPIFLAAEIDRHPGKLEEYCINDLGLINPDIRIRKIKLQSLVKKDGYLIHITGKTLDRIALRNATGLKLDISWINYIKKLENFAEKGSMESGVISKDKNIELYKLLMDKHKNGIFKNRPNPIGEKLENKLSMFMGLEQEKQINVLVQLLNTTAIVSAAKADLTDIGEAKATGVMLISKKIEGYKRIFLVNQSVTGLYEEEIDLLTV

SEQ ID NO: 2984 - protein, 610 aa, Unknown
  Description of Unknown: uncultivated organism sequence
  Category: MG91 effectors
  Description: MG91-176 effector
MIIFTKISEFIISYWMPVKKDDKPRFVLEMPLKVEQWQADILNVRYELMRRMYNQARRILLSHFYYMVQKNEYQECASNKRERAVYIKNHPIFIKGVTDKKGNVKPITFTEFGIKDVVLSFVTRDVGSGKTYKDFGINTSFADCVASNLWAAWEKFMYDGKCKGVAFKRRFNTISIGKNNGCFGGLKLSLESMTLSVNVNGKQKGNAKFITLPVCGDNQSEYEMQALQGGLESICVVSIARKLIRGKYKYYLQLTIKGHAPNKGRALGCGTVGVDVGPSTVAFVSQSDVQINRLASECDDIEDVIGKIQQKMDRSRRATNPQNFNEDGTLKRISRKNGERRIWNDSRRYRLLCKQKAELQRKQAAVRKMSHILKINQILSLGDTFFVENNPISQWTKRAKETKVSEKTGRYCSKKRAGKSVANHAPAMFVTLLKNKVQSLGGRCREVDIKNAASRFDFTDGQFKVHGLDERIVTLSNNKTHQRDILAAFNLQHIICVDDDKKLKKYDIVRMYADYPAFCDMERAEIEKFVSGEKETDRHTIGAIEELKVVLSSHADDPSVLYSVDKLSANSEGNKTGKKAGSALVHESNDRVLEVLNESTLFTIKDLHVT

SEQ ID NO: 2985 - protein, 1127 aa, Unknown
  Description of Unknown: uncultivated organism sequence
  Category: MG91 effectors
  Description: MG91-177 effector
MSKKILSLDLGITSIGYSILEEVSENRYSLLDYGLSMFDKATDKDGNSKKLLHSSASSAKNLYTLRKERKKSLAKLFELFNFSTSLKLLNQEKENLYINKWELRAKEAFCRRLEVGELFSILYALAKHRGYKSLESGDLLEELCEELNLECNLTKKTEDEDTGKIKLALKTVESLRLDNPHKTVAQIIYEEEILKFTPTFRNHDNYNYMIRREYINDEIKKILLAQEKFGFFKSDFDVTAFIDSVIEIIDDQKESTNDLSLFGNCEYYPKHKVAHQYSFLSDIFKMYESVSNITFNTKPTLKITPSQIKLIAEDFFAKVKKGKNIGDIKYKDIRKVLKLDDDVKIFNKEDSYLRAGKKIENSIIKFHFVNSLSKIDNSFIVIALEDERGYEVLQNIFDVLAYEKSPKSIYEKLKNLVDEKTIIALIQNKHGNSLNISHYAMLQFIPYFEEGLTTDEIKKKIGLERKEDYSKYRKGIKHLNIVEFEKDENLEINNHPVKYVVSATLRVVKHLHSVYNGFDEIRVESTRELSQNEQTKKDIEKANRAQEKEFSRIVEDKEYQKIADSYGKNIKKYARKILLWEEQEYLDIYSGKVIGLGEIFSNEVDLDHIVPQSLGGLSVKHNFVLAHRDTNVQKSNRLAVDFVSDKEAFINRVEHLFSSHKINWKKRKNLLATNLDETFQDVFESKSLRATSYIEALTAQLLKCYYPFIDKKKQVDGSAVRHIQGRATSNIRKLLGVKTKVRDTNIHHAIDALLIGFTNHSWLQKLSNTFRENKGVINDEARAKIKKEFPIIELVVNDEVEYLEPKELCERIENTFNCYGEESVFYKDIWGKNRVVSFWVSKKPMVSKIHKDTIYAKKKEGIFTVRENIINKFIGLKITPTMSSQKFMDIFKKNILEKMYLFKVNPKDFISLVIQKRADEIAELLESFETLDKKDKESMSQAKVDLEVLIHKEILDNSENSIRKVKFFQTNLTGFDVRGGLATKEKTFIGFRAWLEDDKLHYVRIDVANFKKIQKLNDSSFKVYKNDEIFFIMPDGSRRGGKIVSFLEETKKSAFQNAKYPTSSEYQPMQFCKMDKGKKSGAKQQSIGKAIGIIKLNIDIIGNIKSYQVIGNAESELLDFVKETVHG

SEQ ID NO: 2986 - protein, 1127 aa, Unknown
  Description of Unknown: uncultivated organism sequence
  Category: MG91 effectors
  Description: MG91-178 effector
MSKKILSLDLGITSIGYSVLEEVSENRYSLLDYGLSMFDKPTDKDGNSKKLLHSAASSTKNLYTLRKKRKKSLAKLFELSDISTSSKLLNQEKENLYINKWELRAKEAFCRRLEVGELFTIFYALAKHRGYKSLESGDLLEELCEELKIEYNFTKKKEDEDKGKIKLALKTVESLRLENPHKTVAQIIYEEEILKSTPTFRNHDNYNYMIRREYINDEIKKILLAQEKFGFFKSDFDVTAFIKRVIETIDDQKESTIDLSLFGNCEYYPKYKVAHQYSLLSDIFKMYESVSNITFNTKPTLKITPSQIKVIAEDFFAKVKKGKSIGEVKYKDIRKILQLGDDVKIFNKEDSYLRAGKKIENIIIKFHFVNSLSKIDNSFILNALEDERGYEVLQKIFDVLAYEKSPKSIYEKLKNLVDEKTIIVLIQNKHGNSLNISHYAMVQFIPHFKEGLTTDEIKKILGLERKEDYSKYRKGIKYLTIAEFEKDENLEINNHPVKYVVSATLRVVKHLHSVYGAFDEIRIESTRELSQNEQTKKDIEKANRALEKEFSRITEDKEYQKIADSYGKNIKKYARKILLWEEQEYLDICSGKVIGLGEIFSNEVDLDHIIPKSLGGLSVKHNFVLAHRDTNVQKSNRLALDFVSDREAFINRVEHLFSSHKINWKKRKNLLATSLDETFQDVFESKSLRATSYIESLTAQLLKCYYPFTNKKKQLDGSAVRHIQGRATSNIRKLLGVKTKVRDTNIHHAIDALLIGFTNHLWLQKLSNTFRENMGLIDDEARAKIKKEFPIIELVVNDEVEYLEPKELCDRIENAFNSYGEESVFYKDVWGKNRVVSFWVSKKPMVSKIHKDTIYEKKKDGIFTVRESILNKFIGLKITPTMSSQKFTDIFNKNILEKMYLFKVNPKDFICVVIQKRADEIAELLGSLEALDKKDKERVSKAKVDLEALIHKEILDNNGNSIRKVKFFQTNLTGFDVRGGLATKEKTFIGFRTWLKEGKLNYERIDVANLQKIEKLNDSSFKVYKNDEIFFIMPDGSRRGGKIVSFLEETKKSAFQNAKYPTSSEYQPMPFCKMNKGKKSGAKQQSIGKAIGIIKLNLDIIGNIKSYQVIGDAKSDFLDFVKESIRG

SEQ ID NO: 2987 - protein, 1351 aa, Unknown
  Description of Unknown: uncultivated organism sequence
  Category: MG91 effectors
  Description: MG91-179 effector
MKYYLGLDMGTDSVGWAVTDEHYNIVRAKGKDLWGIREFEEAKTAADRRIQRTSRRRLEREKARIGLLKDYFKDEIDKVDPSFYARLDNSFLKIEDKAEEVQYKNILFNDEDFTDRDYYKKYPTIFHLISELIHNTTPHDVRLVYLACLNIFKHRGNFLNPALSKDNTRIDISDKYTELRQALSEQTNIILSEEFNENSFKAIMCDSSKSRTLKYEGLKDLFSIEKSDKQKQEILKAIAGLKVNAKNIFDLDTEEKIEFSFYEGNFDDKAAELEKEMGEDFFNIIALMKEIYDACEWDTVMAGYEYLSDSRVASYEKHKKDLVILKRAFRNNKSKDDYERFFRTDEDGTYGDYTGSNNSREKHRRRGSKHRQEDFYDSVKKEFKGLEKNGDPDIDYILTEISNGTFMPKQLTPSNGVIPFQAHYKELNAILNNASNYLGFLNDIDSESGQSVKADILQIFEFKLPYYIGPVTTKSAENGGNGWVIRRENGKVLPWNIEQKIDTKATSEAFIQRMVRKCTFLSDEKVLPKSSLLYEKFSVLNAINAISIKGERISTNIKQDLYHDKFENGKKVTKTQIVRYLNGRGLDVTENDITGIDDIITSQLSTYHRFYQIFGDDMKKDSYKNMAEDIIYLSTIFGDEKKFLKDKIKEKYGDKLSDEQIKKVLSIKCTDWGKLSKEFLELKGCRKNTGEEISLIDAMWETSLNLMELINSDEFNFNEVLNERQTKAFSSLKELKPEDLDDMYFSAPVKRMVWQTLLIIKELEQVIGSAPERVFVEVTRSHEESKRTVSREKLLLDLYKNEDKYWKDIISEASVNGRIRSKRMYLYLKQQGKDLYTGKEIPLDEVFNKGKYDIDHIYPQSLTKDDSLDNNMVLTDKSVNNHKQNIYPLEKSIRDNCYALWTALHAKGFINDEKYKRLTGNQPLTDGQLEGFIARQLVETSQGTKAICDILTQALPATKVIYSKAKVVSDFRNQYHIYKSRIANDLHHAHDAYLNVVVGNSYYVKFTDSPHRFIKERFRCDGGKYNYNLATFFESDVSNGKETAWIGSGKEYNNDNEKGTILTVRKMLAKTSPMMTRLNFVNKGSIAKEQLISADKCKKDSYLQIKVNDARLDVTKYGGYQKVSAAYFFLVESAGKKGEKIRTLETVPVYLADKIEKNPALLEQYCKDILKLNNIRISVRKIKIQSLIKRNGYFLHISGKSSNQILLRNATNIFYNQEKINYIKKIEKYVDKQEVDEEINTEKNIELYDYLTAKHNGKILLHRPNPIGEKLTKRKDKFAELSLAEQILCLYEILTSTAIVAGGAANLKQLGESPSTGVMTMNKNISKEKELLLINQSVTGIYTNTIDLLKI

SEQ ID NO: 2988 - protein, 64 aa, Unknown
  Description of Unknown: uncultivated organism sequence
  Category: MG91 effectors
  Description: MG91-180 effector
MKVEKWQADILDKRYEYLRQIYNIVQQKLVRQYIYFSQQKAYRDCKNHINDCGLEIKYNTKNYE

SEQ ID NO: 2989 - protein, 1122 aa, Unknown
  Description of Unknown: uncultivated organism sequence
  Category: MG91 effectors
  Description: MG91-181 effector
MLKRILSLDLGVTSIGYSVLEEKENDKYSLLDYGVSMFDAPYNKDGNSKKLLHSQNASTSKLYHLRKKRKKDLAKLFEKFKLGKSEEFLKQEKQNRYKHKWELRGKEVFERKLDISELFTIFYFLAKHRGYKSLDSSDLLEELIEKLGLSKEEKKSKKDDEKGKIKQALRTIEDLKQKFPEKTVASIIYMIEMQKSNPTFRNHDNYNYMIRREYINEEIEKILNIQKEFGLFDKSFELDKFTKELKEIITVQKESTNDLSLFGKCEFYPEYKVAHQYSLLSDIYKMYQAVSNITFDKSKIKIKKEQIQKVANFFLKKIKSGKKISDIKYKDIRAILNLDDAVKIFNKEDNYLRKGKKQENTIVKFHFVSNLAKFDNSFILKAFEKENPYRELKEIFDVLHEEKSPKSIYEKLKDKVDKKTIIELIKNKSGNSLNISSEAIIKCIPYFEDGLTLDEIKQKLDLKRSEDYSSFKKGIKYLHVNQFEKDDKLEINNHPVKSIVSITLRLIKYLHAIYGNFDEIKVESTRELSQNEQIKEDIKKANRDLEKKIDEIVENTEYQNIANQYGKNLKKYARKLLMWEEQERLDIYSGESIGLADIFSNIVDLDHIVPQSLGGLSVKHNFVLVHRNSNLKKSNNLPINFISDKQGYINRVEHLFSEHKINWKKRKNLLAENLDEIYKDTFESKSLRATSYAEALTAQILKRYYPFTNKTKQKDGSAVKHIQGRATSNIRKLLHIKTKSRDTNIHHAIDAILIGVTNHSWLQKLSNTFRENFGVIDEVVRKNIKKAVPYIEGMELKDLVNEIEQNYNSYGEDSIFYKDIWGKTKAINFWVSRKPISSKIHKDTIYAKKPNGIFTVRENIINKFIALKITAKTKPEDFINKFEKDILKKMYLYKTNSNDVICKIVIQRAKDIQKLLVSFENLDTKDKEVMTDAKSKLNALIHSDLIDNNGNIIRKIKFVPKTSPKDGFDIRKGKAISEKTFIGFKTYLEKDKLKYNRIDISNTQKINGKFVVYSKGFKVFKNNLVFFIFSDGTYKGGKIVSFLADKGIAAFSNSKFPASIANQPHSFLTFFNGKPNSHKQHSINKAIGLIKLDLDILGNIKSQQTIGNVQSKLFDFIKEILK

SEQ ID NO: 2990 - protein, 1116 aa, Unknown
  Description of Unknown: uncultivated organism sequence
  Category: MG91 effectors
  Description: MG91-182 effector
MKQILSLDLGITSVGYSVIQEHETDKYSLIDYGVSMFDKPTDKDGNSKKLLHSQALSAKNLHKLRKKRKQNLASLFEKYHLDNRERLLQQEKDNLYKNKWELRAKKVFEKQLSIGEIFTILYHIAKHRGYKSLDSGDLLEELCETLGIETETTKPKKDDERGQIKQALKSVEALREEYPQKTVAQIIYELESKKENPIFRNHDNYNYMIRREYINDEIRKIIKVQIAFGAFRTIDDAFINDVIAVIDDQKESTNDLSLFGKCEYYPEYYVAHQYSLLSDIFKMYQAVANITFNKEKIKITKEQIALIAEDFLGKIKKGKSVKDIKYKDIRKVLKLDDDIKIFNKDDSYLNKGKKQENTITKFHFVDILSKIDKSFVEDIFASDKSYTIMREIFDVLHYEKSPKLIYKQLKNKISDEQVIIDLIRNKKGNSLNISSFAMLQLLPYLKEGLTLDEVKQKLGLQRQEDYAEYKKGIKYLHITNYEKDDELEINNHPVKYAVSAALRVVKHLHTEYGTFDEIKVESTRELSLGEKARKEIEKANKAFEKEIEQIVENVEYQKIAKSYGKNLRKYARKILMWEEQERLDIYSGKSIGITDIFSNSVDLDHIVPQSLGGLSVKHNFVLVHRDENLQKSNQLPMNYIKDTQAYTNRVEHLLREHKINWKKAKNLLATNLDEVFKDRFESKSLRATSYIEALTAQMLKRYYPFKDVRKLKDGSAVRHLQGRATSNIRKVLGVKTKSRETNIHHAIDALLIGVTSHSWLQKLSNTFRENFGCIDDEARKNIKKALPYMDGLEIKDLVKEIEEQYNSFGEDSIFYRNIWGKVKTVNFWVSKKPMSSKVHKDTIYAKKGDGIYTVRENIIAKFIGLKVIPTTSPEEFMKRFHKNILQKMYLFKTNPHDVICKLVEQRGEEIKELLWSFEFLDVKNKEEMSEAKTKLELLIHKDLLDNNGNVIRKVKFYQTNLTGFDVRGGLATKEKTFIGFRAYKENEKLEYERIDIANIEKIQKVNDGSFKAYKNDVVLFIFDDKVYKGGKIVSFLEEKKMAAFSNPKYPANIQSQPESFLTMFNGKANSHKQVSISKAKGIIKLYIDILGNIKSYQVLGNAKSKILDEIKSIVSH

SEQ ID NO: 2991 - protein, 1136 aa, Unknown
  Description of Unknown: uncultivated organism sequence
  Category: MG91 effectors
  Description: MG91-183 effector
MQEEEIMSKKILSLDLGTTSIGYSILNEMDNDRYALIDYGISMFDKATDKDGKSKKLLHSASQSSANLHDLRKERTQNLAMLFEKYKLGRVDALLEQERENRYTDKWYLRAEKAFSEKLETEELFTVLYLMAKHRGYKSLDTDDLLEELLLDLGFEVEEKKEKDAEKGKIKQALKAVESFRQKYPEKTVARIIYEIEIKKDNPTFRNHDNYNYMIRREYINEEIRKIVQAQSKFGLFAKDFDVEVFIKELIVTIDDQKDSTNNLSLFGNCEYYSEHKVAHQYSLLSDVFKMYQSVANITFRKIKITKEQIQIIADDFFKKIQIGKNIADIKYQDIRKLLKLGEGVQVFAKEDYHLDKKGKKVHHTITKFHFLANLSKIDNRFIKSAFEKENKFEILKEIFDVLEFEKAPRGIYIQINEIFMKHKLVDDERLKDETIINLIKYKSGSSLNISAYTMIKFIPYFEKGMTSDEIKQVLKLERNEDYSNYKKGIKYLHTTNFEKDDNLEINNHPVKYVVSATMRLVKHLHATYGAFDEIRVESTRELSQNEETKKAIEKANRENEVKFQKIIENEEYIKIANHYNKNLKRYARKLTLWEEQEKLDIYTGKTIGFEDIFTNAVDIDHIIPQSLGGLSVKHNLVLAHRDDNVKKSNQLPMNFVKDKVDYVNRIEYLFKEYKINWKKKINLLATTLDERYKDTFESKELRATSYIEALTAQMLKRYYPFPDKKKQANGQAVAHVQGRATSNIRKLLGVKIKVRDTNIHHAIDAILIGLTNKSWLQKLSNTFRENMGVIDDRARANIKKEIPLIEGIDPKELVELIEDAYNVYGEESVFYKDIFGKTKAVNFWVSKKPMSSKIHKDTIYAKKPNGLFTVREDIIKQFIALKITTTTDSELFMKAFEKKILQKMYLFRTNPNDVICRIVKSRGDELKSLLQSFVGVDTKDKEIMAEAKEKLDALMHKELLDNNGNTIRKIKFYQSNLTGFDIRGGLATKEKTFIGFKAVLEKEKLVYERIDASNFKRIKKENDASFKVFKNDVVFFVFSDNTFRGGKLVSFLEDGTIASFQNPRYPAAVQFQPSLFCILGKDKEGNPKKSSSKQYKNGKAIGIIKLNLDILGNIKSYSKFGEVSQEVEKSIFHKE

SEQ ID NO: 2992 - protein, 1104 aa, Unknown
  Description of Unknown: uncultivated organism sequence
  Category: MG91 effectors
  Description: MG91-184 effector
MKKILSLDLGITSIGYSILEKKQNNHYTLIDYGVSMFDSPFDKDGKSKKLLHSTNTSMSNLYAKRKQRKKALAKLFEEFGLEKAHKLLQQEKQNIYKNKWQLRCDDVFTRELSVGEFFTILYFIAKHRGYKSLDTNELLEELCEELKLNCEMKSSKKDDEKGKIKQALKRVEELKQNTNKTVAQIIYELELQKQTPTFRNHDNYNYMIRREYIEDELKKLVDAQQHFFKNNKDEFFEKLKEIIIKQDESSNDLNLFANCEYYKEHKVANQYSVVADIFKMYESVANITLNKEKITKEQIKLIADDFFIKIKKGKNIADIKYKDIRKILKLSDDIKIFGKSDSYVSKGKTIHNTIIKFHFLNNLSKFDNSFIVQNLDNLEKLAEIFEVLNKEKSPKTIFEKLNGNVDEKTIIKLIRYKSGKSLNISHYAMLKFIPYFQEGLTTDEIKQKLDLNRCEDYLAYKKGIKYLHINQFEKDDNLEINNHPVKYIVSAVMRVVKHLHTLYGAFDEIKVESTRELSLDDKTRKDIQKANQEFEKKLDDIKQNSQYQQIAQEYDKNLSKYTKKILMWQEQDRVDIYSGKTIGLNEIFSNEVDIDHIVPQSIGGLSVKHNLVLVHRDTNLQKSNQLPMNFVADKVGLKNRVEKLFSEHKINFKKMKNLLATNLDEIYKDSFESKSLRATSYIEALTAQMLKRYYPFADKQKQKDGSAVRHIQGRATSNIRKLLHVKTKVRDTNIHHGIDALLIGVTSHSWLQKISNTFRENFGVIDDKARERVKKELPLIEGVSVAELVAHIEENYNIYGEESVFYKDVFGNVRVVPFWVSKKSMVSKIHKDTIYAKKQNGIFTVREKILNKFISLKITPKTSSDEFMKKFKKEILEKMYLYKTNPKDKICAIIEQRAFEIAKLLDSLQLKDTTDKEMLSETKKYLDEFIHQDLKDYNGNVIRKVQFYQTNLTGFEIRGGLATKEKTFIGFSAILNGKKIKYKRIDVANFESMKKVDGFKVYKNDVVFFIYPDGSFNGGKIVSFLEDKKMASFSNPRFPANIGLQPHSFVTLFKGKANSHKQHSLNKAIGIIKLNLNVLGNIKSFSSMDEVDGELLEFLKGLKG

SEQ ID NO: 2993 - protein, 484 aa, Unknown
  Description of Unknown: uncultivated organism sequence
  Category: MG91 effectors
  Description: MG91-185 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSLCAWSAWDKKLFGKGDFVKTDKVVNIFCSRNKKERFCGFDYDLSTFTISIKSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARAKATSMTKLGRIRSKKRYGKSIMNRAPSEFLVILKNKLLYYPKGKYYDVPSSYACTQFDFTNESFTEHKISERRIVTSDGIQHNRDTLAAFNIKNAIVNDTSTKKKKVTKSKEFFDIVRMKASYNEFCLMERYLLSV

SEQ ID NO: 2994 - protein, 1126 aa, Unknown
  Description of Unknown: uncultivated organism sequence
  Category: MG91 effectors
  Description: MG91-186 effector
MSKKILSLDLGITSIGYSILEELNNDRYSLIDYGVSMFDKPTDKDGKSKKLLHSASVSAKKLHTLRKERKTNLAQIFEDYKLSNKTTLLNQEKQNIYTNKWELRAKKAFEEKLEISELFTIFYVLSKHRGYKSLDSDDLLEELCQKLGIEVDTKKATKEDDEKGKIKKALQTIENLRIKYPDNTIAQIIYETEILKENPTFRNHDNYNYMIRREYINDEITKIIKAQNGFKAFNFDVDEFIEAIINTIDDQKDSTNNMDLFGNCEYYKEEKVAHQYSLLSDIFKMYQSVSNITFNIAELCEVNPLQKNIKIQKEQIKLIADDFFTKIKKGKNIADIKYKDIRKVLKLSDDFKIFNKEDSYLNKGKKQENTITKFHFVNNLSKIDNSFILNALKQDNRYEILREIFDVLSQEKAPHSIYEKLKDKVDDKTIISLIKYKNGNSLNISHHAMIKFIPYFEEGLTTDEIKQKLGLDRKEDYSEFKKGIKYLHIKTFEKDNNLDINNHPVKYVVSATLRVIKHLHTTYGAFDEIRVESTRELSQNEQTKKDIEKANRALEKEINNIVENKEYQKIADSYGKNLKKYARKILMWEEQNRLDIYSGKNIGFEDIFTNSVDLDHIVPQSLGGLSVKHNFVLVHRDTNLQKSNQLPINFIKDKQEFINRVEYLFSEHKINWKKKINLLANNLDEVFKDSFESKSLRATSYIEALTAQVLKRYYPFPNEKKQNDGSAVRHIQGRATSNIRKLLHVKTKVRDTNIHHAIDAILIGLTNASWLQKLSNTFRDNMGVIDDEARAKIKKEMPLIEGIEPKELVEMIEDRYNEFGEDSIFYKDIFSNVKAVNFWVSKKPMVSKIHKDTIYAKKQDGIFTVREGIINKFVGLKTTTTTSPSKFMESFEKNILKKMYLHKTNPKDAICQIVQKRANEIAILLESFVDLDTKNKELMSDSKVKLDELFHSDMLDNNGNVIRKVKFFQTNLTGFEIRGGLATKEKTFIGFKATLKDSKLKYTRIDVANFEKIQKENTDSFKVFKNDLVFFIYSDGSFRGGKIVSFLEEKGMGAFSNSRFPASIGLQPHSFLTMFNGKANSHKQISLNKAIGIIKLNIDIIGNIKSYQVIGDVKGELLEFIKKLTQ

SEQ ID NO: 2995 - protein, 1122 aa, Unknown
  Description of Unknown: uncultivated organism sequence
  Category: MG91 effectors
  Description: MG91-187 effector
MLKRILSLDLGITSIGYSVLEEKENDKYSLLDYGVSMFDAPYNKDGNSKKLLHSQNASTSKLYHLRKKRKKDLAKLFEKFKLGKSEEFLKQEKQNRYKHKWELRGKEVFERKLDISELFTIFYFLAKHRGYKSLDSSDLLEELIEKLGLSKEEKKSKKDDEKGKIKQALRTIEDLKQKFPEKTVASIIYMIEMQKSNPTFRNHDNYNYMIRREYINEEIEKILNIQKEFGLFDKSFELDEFTKELKEIITVQKESTNDLSLFGKCEFYPEYKVAHQYSLLSDIYKMYQAVSNITFDKSKTKIKKEQIQKVANFFLKKIKSGKKISDIKYKDIRAILNLDDAVKIFNKEDNYLRKGKKQENTIVKFHFVSNLAKFDNSFILKAFEKENPYRELKEIFDVLHEEKSPKSIYEKLKDKVDKKTIIELIKNKSGNSLNISSEAIIKCIPYFEDGLTLDEIKQKLDLKRSEDYSSFKKGIKYLHVNQFEKDDKLEINNHPVKSIVSITLRLIKYLHAIYGNFDEIKVESTRELSQNEQIKEDIKKANRDLEKKIDEIVENTEYQNIANQYGKNLKKYARKLLMWEEQERLDIYSGESIGLADIFSNIVDLDHIVPQSLGGLSVKHNFVLVHRNSNLKKSNNLPINFISDKQGYINRVEHLFSEHKINWKKRKNLLAENLDEIYKDTFESKSLRATSYAEALTAQILKRYYPFTNKTKQKDGSAVKHIQGRATSNIRKLLHIKTKSRDTNIHHAIDAILIGVTNHSWLQKLSNTFRENFGVIDEVVRKNIKKAVPYIEGMELKDLVNEIEQNYNSYGEDSIFYKDIWGKTKAINFWVSRKPISSKIHKDTIYAKKPNGIFTVRENIINKFIALKITAKTKPEDFINKFEKDILKKMYLYKTNSNDVICKIVIQRAKDIQKLLVSFENLDTKDKEVMTDAKSKLNALIHSDLIDNNGNIIRKIKFVPKTSPKDGFDIRKGKAISEKTFIGFKTYLEKDKLKYNRIDISNTQKINGKFVVYSKGFKVFKNNLVFFIFSDGTYKGGKIVSFLADKGIAAFSNSKFPASIANQPHSFLTFFNGKPNSHKQHSINKAIGLIKLDLDILGNIKSQQTIGNVQSKLFDFIKEILK

SEQ ID NO: 2996 - protein, 1129 aa, Unknown
  Description of Unknown: uncultivated organism sequence
  Category: MG91 effectors
  Description: MG91-188 effector
MKKLLSINLGITSIGYSVLNEQDNDKYSLIDYGVNMFDTPYDKDGNSKKLIHSQIKSTKKLYELRKERKKNLSKLFEDFGFAKKEDFLNQEKENLFINKWGLRAKKAFEEKLTFQELFSILYLIAKHRGYKSLDTDDLLEEFCEKLGLNQEKKKDNGKDNEKGKIKQALKTIETLKLQFPQKTIPQIIYEVEIQKENPTFRNHDNYNYMIRREYINEEIKALVLSQEKFGLFDKNFDSKAFIEKLIETIDDQKESSNDLSLFGNCEYLKNEKVAHQYSLLGDIYKMYQSVANITFNSNPTIKISKEQIKLIANDFFDKLKNGKNISDIKYKEIRKILKLSDDFKVFNKEDSYKSKDKTQENSITKFHFVNNLSKFDKDFIKSILEKSNKYDILKEVFDVLRDEKQPKPIYDKLNNIFSKYDLIKNESIKNNTILELIKNKTGSSLSISHQAMINIIPYFEDGSTIDEIKQKLNLSREEDYLSYKKGIKYLSVAQFENNNNLPINNHPVKYVVSAALRLIKHLHVTYGAFDEIRVESTRELSLNDESKRNIDKVNRENEAKITAILENIEYQQIAQTYGKKLEKYARKILIWDEQERFDIYNGKSIGFGDIFSNSVDIDHIVPQSLGGLSVKHNLVLVHRDTNLQKLNQLPLNFIADKQGFIDRIEYLFKEHKISWKKRKNLLATNLDDTYKDTFESKSLRATSYIEALTAQILKSYYPFPNQTKNSMEVRHIQGRTTSNIRKLLKVKTKIRNTNIHHAIDAILIGLTNQSWLQELSNTFRENMGVIDDVARQNIKKVIPLIEGIEPKELIEMIENNYNAYGEDSIFYKDIFGKTKAVNFWVSKKPMVSKIHKDTIYSKKPNDFYTVKENILNQFIALKVNNDTKANKFYEDFKKNILEKMYVYKTNPNDVICKIVQNRAYDIKELLTSFETIDKKDKEALSEAKQKLDTLIHNPLLDNNNKPIRKVKFYQTNLTGFNIRGGLATKEKTFIGFKASLKNDKLFYERIDVANKNNIKDNDFLIIRNNLICINFKNKNLLGFVESFDENTNKIRMYDSRYPKRLENQPERFKVASGKGRKEFGIAGAIGIIKLNLDILGNINSYQIIGTIQNELYSFFKKLKNDKGNLPINT

SEQ ID NO: 2997 - protein, 1129 aa, Unknown
  Description of Unknown: uncultivated organism sequence
  Category: MG91 effectors
  Description: MG91-189 effector
MEKIMNKKILSLDLGITSIGYAILNEIDNDRYELVDYGVSMFDKATDKDGKSKKLLHSASQSSANLHGLRKIRTKNLASLFEKYNLGNAVDFLRQERENTYIDKWYLRAEKSFTEKLKIEELFTILYLMTKHRGYKSLDTDDLLDELLVELGFEVEAKKEKDAEKGKIKQALKTVESYRKKYPAKTVARIIYEIEIKKENPTFRNHDNYNYMIRREYIREEIKKIVLAQNEFGLFTKDFDVDSFIEELIATIDDQKDSTNDLSLFGNCEYYSEHKVAHQYSLLSDIFKMYQSVANITLNKTKITKEQIKIIADDFFKKIEKGKNIADIKYQDIRKVLKLNDEVKIFGKEDYHLNKKSIKVHHTITKFHFLSSLGKIDNTFIKSTFTKENKLEILQEIFDVLEFEKAPKSIYNQLNEIFGKYVLVEDESVKNKTIINLIKYKSGNSLNISAYAMRKFIPYFEKGMTSDEIKQELKLERNEDYSNYYKGIKYLHVNQFEKDDNLEINNHPVKYVVSATMRLVKHLHATYGAFDEIRVESTRELSQNEETKKAIDKANKANEKKFQEIVENEEYQKIANHYNKNLKKYARKIMLWEEQEKLDVYTGKTIGCEDIFTNVVDIDHIIPQSLGGLSVKHNLVLAHRDENVQKSNQLPMNFVKDKKAYENRIEHLFKEYRINWKKKINLLATTLDEAYQDTFESKALRATSYIEALTAQMLKRYYPFLDKKKQANGQAVAHVQGRATSNIRKLLDVKIKVRDTNIHHAIDAILIGLTNKSWLQKLSNTFRENMGVIDDEARANIKKEIPLIEGVEPKELVELIEDAYNIYGEESVFYKDIFGKTKAVNFWVSKKSMSSKIHKDTIYAKKPNNLFTVREDIIKQFIALKITVTTDSETFMKAFEKKILQKMYLFKTNPNDVIVKIVNHRGNELKSLLQSFVNIDIKNKEVMSEAREKLDTLIHQKLVDNNGNIIRKVKFYQSNLTGFDIRGGLATKEKTFIGFRATSNNEKLFYERIDASNFKRIQKENDGSFKVYKNDVVFFIYEDEIFKGGKIVSFLEDKKIASFSNPRYPASIKFQPHSFLTLFKGIPNSHKQYSLNKAIGIIKLNLDILGNIKSYSKFGVVSKEVELKIFHKE

SEQ ID NO: 2998 - protein, 53 aa, Unknown
  Description of Unknown: uncultivated organism sequence
  Category: MG91 effectors
  Description: MG91-190 effector
MAKETFVLTLPLKVEKWQADILDKRYELLRQTYKYGATEIGTSVHLLRSTERI

SEQ ID NO: 2999 - protein, 348 aa, Unknown
  Description of Unknown: uncultivated organism sequence
  Category: MG91 effectors
  Description: MG91-191 effector
MILSFNINGKKNSKAKKIILPINVKNLTEYEMYALKDGYDSINVVTIIRKMIRGKYKYYVQFTIKGEKPQKGRTLGKGNVGIDIGPSTVAISSLNGVTIDTLAEKCNNIEDKISDIERKMDRSRRATNPQNFTEDGQIKRINRKKGEIREWKYSKRYVKLNNKKRELLRKQSAIRKLQHNIKANEVLSLGDTFIVENNPISAWAKRAKGVRKNKNGKIQTNKRFGKSIGNRAPSMFVTILQNKVKSLKGKFVPVNPKNAASRFDFTNGDFTEHNLDERKITLSNGNTHQRDMLAAFNLQHIDLTNDDLKKYNVDEMIEDYPIFCKLEKQEIKRFINGMKISNKSNIGI

SEQ ID NO: 3000 - protein, 1104 aa, Unknown
  Description of Unknown: uncultivated organism sequence
  Category: MG91 effectors
  Description: MG91-192 effector
MKKILSLDLGITSIGYSILEKKQNNHYTLIDYGVSMFDSPFDKDGKSKKLLHSTNTSMSNLYAKRKQRKKALAKLFEEFGLEKAHKLLQQEKQNIYKNKWQLRCDDVFTRELSVGEFFTILYFIAKHRGYKSLDTNELLEELCEELKLNCEMKSSKKDDEKGKIKQALKRVEELKQNTNKTVAQIIYELELQKQTPTFRNHDNYNYMIRREYIEDELKKLVDAQQHFFKNNKDEFFEKLKEIIIKQDESSNDLNLFANCEYYKEHKVANQYSVVADIFKMYESVANITLNKEKITKEQIKLIADDFFIKIKKGKNIADIKYKDIRKILKLSDDIKIFGKSDSYVSKGKTIHNTIIKFHFLNNLSKFDNSFIVQNLDNLEKLAEIFEVLNKEKSPKTIFEKLNGNVDEKTIIKLIRYKSGKSLNISHYAMLKFIPYFQEGLTTDEIKQKLDLNRCEDYLAYKKGIKYLHINQFEKDDNLEINNHPVKYIVSAVMRVVKHLHTLYGAFDEIKVESTRELSLDDKTRKDIQKANQEFEKKLDDIKQNSQYQQIAQEYDKNLSKYTKKILMWQEQDRVDIYSGKTIGLNEIFSNEVDIDHIVPQSIGGLSVKHNLVLVHRDTNLQKSNQLPMNFVADKVGLKNRVEKLFSEHKINFKKMKNLLATNLDEIYKDSFESKSLRATSYIEALTAQMLKRYYPFADKQKQKDGSAVRHIQGRATSNIRKLLHVKTKVRDTNIHHGIDALLIGVTSHSWLQKISNTFRENFGVIDDKARERVKKELPLIEGVSVAELVAHIEENYNIYGEESVFYKDVFGNVRVVPFWVSKKSMVSKIHKDTIYAKKQNGIFTVREKILNKFISLKITPKTSSDEFMKKFKKEILEKMYLYKTNPKDKICAIIEQRAFEIAKLLDSLQLKDTTDKEMLSETKKYLDEFIHQDLKDYNGNVIRKVQFYQTNLTGFEIRGGLATKEKTFIGFSAILNGKKIKYKRIDVANFESMKKVDGFKVYKNDVVFFIYPDGSFKGGKIVSFLEDKKMASFSNPRFPANIGLQPHSFVTLFKGKANSHKQHSLNKAIGIIKLNLNVLGNIKSFSSMGEVDGELLEFLKGLKG

SEQ ID NO: 3001 - protein, 1129 aa, Unknown
  Description of Unknown: uncultivated organism sequence
  Category: MG91 effectors
  Description: MG91-193 effector
MKKLLSINLGITSIGYSVLNELDNDKYSLIDYGVNMFDTPYDKDGNSKKLIHSQIKSTKKLYELRKERKKNLSKLFEDFGFAKKEDFLNQEKENLFINKWGLRAKKAFEEKLTFQELFSILYLIAKHRGYKSLDTDDLLEEFCEKLGLNQEKKKDNGKDNEKGKIKQALKTIETLKLQFPQKTIPQIIYEVEIQKENPTFRNHDNYNYMIRREYINEEIKALVLSQEKFGLFDKNFDSKAFIEKLIETIDDQKESSNDLSLFGNCEYLKNEKVAHQYSLLGDIYKMYQSVANITFNSNPTIKISKEQIKLIANDFFDKLKNGKNISDIKYKEIRKILKLSDDFKIFNKEDSYKSKDKTQENSITKFHFVNNLSKFDKDFIKSILEKSNKYDILKEVFDVLRDEKQPKPIYDKLNNIFSKYDLIKNESIKNNTILELIKNKTGSSLSISHQAMINIIPYFEDGSTIDEIKQKLNLSREEDYLSYKKGIKYLSVAQFENNNNLPINNHPVKYVVSAALRLIKHLHVTYGAFDEIRVESTRELSLNDESKRNIDKVNRENEAKITAILENIEYQQIAQTYGKKLEKYARKILIWDEQERFDIYNGKSIGFGDIFSNSVDIDHIVPQSLDGLSVKHNLVLVHRDTNLQKLNQLPLNFIADKQGFIDRIEYLFKEHKISWKKRKNLLATNLDDTYKDTFESKSLRATSYIEALTAQILKSYYPFPNQTKNSMEVRHIQGRTTSNIRKLLKVKTKIRNTNIHHAIDAILIGLTNQSWLQELSNTFRENMGVIDDVARQNIKKVIPLIEGIEPKELIEMIENNYNAYGEDSIFYKDIFGKTKAVNFWVSKKPMVSKIHKDTIYSKKPNDFYTVKENILNQFIALKVNNDTKANKFYEDFKKNILEKMYVYKTNPNDVICKIVQNRAYDIKELLTSFETIDKKDKEALSEAKQKLDTLIHNPLLDNNNKPIRKVKFYQTNLTGFNIRGGLATKEKTFIGFKASLKNDKLFYERIDVANKNNIKDNDFLIIRNNLICINFKNKNLLGFVESFDENTNKIRMYDSRYPKRLENQPERFKVASGKGRKEFGIAGAIGIIKLNLDILGNINSYQIIGTIQNELYSFFKKLKNDKGNLPINT

SEQ ID NO: 3002 - protein, 1137 aa, Unknown
  Description of Unknown: uncultivated organism sequence
  Category: MG91 effectors
  Description: MG91-194 effector
MKKILSLDLGITSMAYSIIEEFENDRYSLVDYGVSMFDKPTDKDGNSKKLLHSASTSTKNLYNLRKKRKQNLAKLFENFNLSTKSRLLNQEKQNLYINKWELRAKKAFDERLDTTELFSIFYALAKHRGYKSLDSGDLLEELYEKLGIDFQAKKEKDKSKADEKGKIKSALSTIENLRLEHPQKTVAQIIYEVELQKKNPTFRNHDNYNYMIRREYINDEIKKIILSQKEFGFFSDGFNVEEFSKRVVETIDDQKDSTSDMSLFGFCEYYKDKEQRVTHQYSLLSDIYKMYESVSNITFNSKPSIKITPQQIKLIANDFFTKVKKGKNILDIKYKDIRKILNLDDNFKIFNKDDTYLNRGKKQEHIIIKFHFVNTLSKINNQFILDIFEQENKYELLKDIFDVLCFEKAPHAIYEQLKEKIKDEKTIVDLIKYKSGNSLNISHYAMLKFIPYFEQGLTADAIKKKLGLNRKENYSAFKKGIKYLHINKFEEDDNLKINNHPVKYVVSSTLRVIKHLHSVYGAFDEIRVESTRELSQNEQTKKDIEKANRAFEKELDIIIEDVEYQKIAEQYGKNLRKYARKILIYKEQERRDIYTGEGIELKDIFTNVVDLDHIVPKSLGGLSVKHNLVLAHRDSNVRKSNQLPLYFVKDKQSFINRVEYLFEHHKINWKKKKNLLASALDETFQDTFESKSLRATSYIEALTAQVLKRYYPFPNKKKQSDGSAVRHIQGRATSNIRKLLGVKTKVRDTNIHHAIDAILIGFTNQSWLQKLSNTFRENMGLIDDEARANIKKEMPIVELIVNDKVEYLKPKELCQRVEESYSEFGEDSVFYRDVWGEVKVVNFWVSKKPMVSKIHKDTIYSKKQDGIFTVRESIINKFILLKITPTTPSQKFIENFQKNILKKMYLFKTNPKDIICQIVQNRAKSIATLLDTFKDIDSKNKELMSDAKTKLEELIHKDLVDNNGNTIRKVKFYQSALTGFDIRGGLATKEKTFIGFRAWLESDKLQYERIDVANFDTIKKKFDNSFRVFKNDVVFFVYPDGSFRGGKIVSFLDDKGIASFSNPKYPSLSEHQPKSFCKMGKDNNGNPKKSGAKQQNINASIGLIKLSLDIIGNIKSYQVTGNAESELLRFIKDVKNG

SEQ ID NO: 3003 - protein, 1117 aa, Unknown
  Description of Unknown: uncultivated organism sequence
  Category: MG91 effectors
  Description: MG91-195 effector
MKKILSFDLGITSIGYSVLTEDEAQKYSLLDYGVSMFDKPTDKDGNSKKLLHAQALSTKKLYKLRKERKKNLALLFEKYALAKASKLLEQEKKNLYMYKWQLRAKKVFEERLSIGEIFTILYHIAKHRGYKSLDSGDLLEELCVELGIKIDVKKEKKDDEKGKIKQALSTIESLRKEYPKKTVAQIIYEVELQKERPVFRNHDNYNYMIRREHINDEIATIIRKQKEFGNFENIDSEVFIVDIIAAIDDQKESTNDMSLFGKCEYYPKEHVAHQYSLLSDIFKMYQAVANITFNKEKIKITKEQIRLLTEDFLNKIKKGKSVKELKYKDVRKILKLDESVKIFNKEDSYQRAGKKVEHTITKFHFVDNLSKIDKSFIEDIFNADESYVLMREIFDVIHKEKSPKRIYEQLKSKVSSEAVIIDLIRYKKGSSLNISSYAMAKFLPYFEEGMTLDAIKEKLDLGRKEDYSVYKKGIKYLHISTYEKDDDLEINNHPVKYVVSAVLRVVKHLHAKHGTFDEIKVESTRELSLNDKVKKEIDKANKAREKEIEKIISNDEYQKIAKEYGKNIHKYARKILMWEAQERFDVYSGKSIGIDDIFSNRVDVDHIVPQSLGGLYVQHNLVLVHRDENLQKSNQLPMNYITDKEAYINRVEHLFSEHKINWKKRKNLLASNLDEIYKDTFESKDLRATSYIEALTANILKRYYPFIDEKKSVDGSAVRHIQGRATANIRKVLGVKTKSRESNIHHGVDALLIGVTNPSWLQKLSNIFRENFGKIDDEARKNIKKALPYIDGVEVKDIVKEIEQKYNSYGEDSIFYKDIWGKAKTVNFWVSKKPMISKVHKDTIYADKGNGIFTVRESIIAKFINLKITPTTFPEDFMKKFHKEILEKMYLYKTNSNDVICKIVQQRAEEIKELLWSFEFLDVKNKEEMQEAKANLESLVHRELFDNNGNVVRKVKFYQTNLTGFKVRGGLATKEKTFIGFRAFKKDKKLEYKRIDVSNFEKIKKSNDGSFKVYKNDIVFFVFDEEKYKGGKIVSFLEDKKMAAFSNPKYPANIQAQPESFLTIFKGKANSHKQVSVGKAKGIIKLKVDILGNIESYQVLGNAKSKLLDEIKSIVSH

SEQ ID NO: 3004 - protein, 1126 aa, Unknown
  Description of Unknown: uncultivated organism sequence
  Category: MG91 effectors
  Description: MG91-196 effector
MSIATKNGHIMKKILSLDLGTTSIGYSVITEKETQKYSLLDYGVSMFDKPIDADGNSKKLLHSQALSAKKLHKLRKKRKQNLAKLFEYYRLDSAVKLLKQEYENRYIHKWQLRAKKVFEEKLSIEEIFTIFYHIAKHRGYKSLDSGDLLEELCIELGIELEQKKEKKDDEKGKIKQALNTIESLRQEYPQKTVAQIIYEVELQKEQPVFRNHDNYNYMIRREYINDEIATIIRKQKEFGNFENIDSEAFISDLIAVIDDQKESTNDMSLFGKCEYYSDEYVAHQYSLLSDIFKMYQAVANITFNKEKIKITKEQIKLIAEDFLNKIKKGKSIKELKYKDVRKVLNLDDSVKIFNKEDSYQRAGKKVEHTITKFHFVDTLSKIDKSFIEDIFNADNSYALMREIFDVVHKEKSPKRIYEQLKDKVSSEAVIIDLIRYKKGSSLNISSYAMVKFLPYFEEGMTLDTIKEKLKLNRKEDYSEYKKGIKYLHISTYEKDDSLEINNHPVKYVVSAALRVVKHLHAKYGAFEEIKVESTRELSLNDKVKKEIEKANKEREKEIEKIISNKEYQKIAQEYGKNIHKYARKILMWKAQERFDIYSGKSIGLDDIFSSRVDIDHIVPQSLGGLYVQHNLVLVHRDENLQKSNQLPMNYIEDKEAYVNRVEHLFSEHKINWKKRKNLLATNLDEIYKDTFESKDLRATSYIEALTANILKRYYPFTDEKKLADGSAVRHIQGRATSNIRKVLDVKTKNRESNIHHSVDALLIGVTNHSWLQKLSNTFRENFGKIDDEARENIKKSLPYIDGAEVKDIVKEIEEKYYSFGEDSIFYKDIWGKVKTVNFWVSKKPMSSKIHKDTIYAKKGDGIFTVRESIIAKFINLKTTPTTSPEDFMKKFQKEILEKMYLYKTNPNDVICKIIKQRAEEIKELLWSFEFLDVKNKEEMQEAKVKLESLVHRELFDNNSNVIRKVKFYQTNLTGFEVRGGLATKEKTFIGFRAIKKGEKLEYERIDVSNFEKMKKSNDGSFKVYKNDIVFFIFDEENYKGGKIVSFLDDKKMAAFSNPKYPANTQSQPESFLTMFQGKPKSHKQVSIGKAKGIIKLKVDILGNIESYQVLGDARSKILDDIKKYSE

SEQ ID NO: 3005 - protein, 1144 aa, Unknown
  Description of Unknown: uncultivated organism sequence
  Category: MG91 effectors
  Description: MG91-197 effector
MVNLMSKKILSLDLGITSIGYSVLQEHSNDKYSLCDYGLSMFDKPLDKDGNSKKLLHSASISTTKLYALRKKRKQNLALVFENFQLASKTSLLEQEKNNQFINKWELRAKKVFEEKLEISELFTILYTLAKHRGYKSLDSGDLLEELCVELGIEIDNKGKKKEDDEKGKIKNALKTIESLREANPKKTVAQIIYEIEIQKVNPTFRNHDNYNYMIRREYINDEIKKIINTQEKFGLFSIAFNTKEFIKKIINAIDDQKDSTNDMSLFGRCQYYKEEIVAHQYSLLSDIFKMYESVANITFNAKPIVKITPKQLKLIADDFFKKIKKGKNIADIKYKDIRKILKLDDNVKIFNKEDSHFIKGKKQERSIIKFHFLNNLSKINNAFILDALEQENKYEILKKIFDVLAYEKAPHSIYEKLKEKIKDKKTIVDLIKYKAGSSMSISSYSMIQFIPHFEQGFTTDEIKKKLELDRKEDYSAFNKGIKYLHLKQFEEDDDLKINNHPVKYVVSATLRLIKYLHSVYGAFDEIRVESTRELSQNEQTKKDIEKANRALEKEIDAIVSNTEYQTIAQNYGKNLRKYARKILLWEEQERLDIYSGKVISVEDIFTNVVDLDHVVPRSLGGLSVKHNFVLAHRDTNVQKSNQLPLYFVMDKQAFINRVEYLFESHKINWKKKINLLANSLDDVYKDTFESKSLRATSYIEALTAQLLKRYYPFPDEKKQSDGSAVRHIQGRATSNIRKLLDVKMKVRDTNIHHAIDAILIGFTNQSWLQKLSNTFRENMGVIDDKARENIKKDFPIIELVINDEVKYVEPKELMELIEDNYNTFGEDSVFYKDIWGRVKTVNYWVSKKPMVSKIHKDTIYAKKGNGLYTNRENIINQFIALKITPTTNAEKFHENFEKKILKKMYLYKTNPKDVICQIVQNRAEDIATLLKSFIGVDSKNKELMSNAKSQLEALLHRELLDNNGNIIRKVKFYQTNLTGFDVRGGLATKEKTFIGFKSWLKDENLHYERIDVANIDTVKKENDSSFKVYKNDLVFFIYPDGSFRGGKIVSFLEENKTGAFQNSKFPMALKYQPSSFCEVDKQGKHTKTKPKSIGKAIGIIKLNLDIVGNIKSYQNIGNVNSECLEFLKENTDGWESSSSHKTL

SEQ ID NO: 3006 - protein, 510 aa, Unknown
  Description of Unknown: uncultivated organism sequence
  Category: MG91 effectors
  Description: MG91-198 effector
MFVVELPLKVEKWQSDVLNKRYELLAKIYNYAQKKLLRQYIYLTQMDEYKKCKTKKDKSVFFKNHPFYFKGITSKITFSEYDVTAFVEKIIKKNVSCDKTYKDFGINSSITEYLGKHIWSAWEKKIYDNGKKVSFKNKGELNTISIRKKSEYFGGLDADIEHMILSFNINGKKNSKAKKIILPINVKNLTEYEMYALKDGYDSINVVTIIRKMIRGKYKYYVQFTIKGEKPQKGRTLGKGNVGIDIGPSTVAISSLNGVTIDTLAEKCNNIEDKISDIERKMDRSRRATNPQNFTEDGQIKRINRKKGEIREWKYSKRYVKLRSKKQELLRKQAAIRKLQHNIKANEILSLGDTFIVENNPISAWAKRAKGVRKNKNGKIQTNKRFGKSIGNRAPSMFVTILQNKVKSLKGKFVPVNPKNAASRFDFTNGDFTEHNLDERKITLSNGNTHQRDMLAAFNLQHIDLTNDDLKKYNVDEMIEDYPIFCKLEKQEIKRFINGMKISNKSNIGI

SEQ ID NO: 3007 - protein, 795 aa, Unknown
  Description of Unknown: uncultivated organism sequence
  Category: MG91 effectors
  Description: MG91-199 effector
MEFKQKAFKELFSKGKQVTLNEFKNYLNNNGINIDEKSEISGVGKSSEMTRFNNKLSSYQVFHSVFGDKLEDKKYYDAAENIIYLGTIYADDKKTFKKAIEEKYGDFLTPDEIKRVSGLKFKDWGTLSAALFNLQGAEKSTGEVMTLIDALWNTQLNFMELINSDAFSYKEELEKYKKKGEGTIQNFKFEELNDYYFSAPVKRMIWQTVLIVREIEHVLGKPPVKMFVEVTRHDEEKEKIPPSRKDTFLSLYKNIKDESHDWKAIIEKADESGVIRSQKMYLYLSQMGRDLYTGKEIELDELFTTKYDIDHIIPQSLKKDDSILNNKVLTSKDFNNNIKQDNPLCEAIDDAHYAERKKLWDRLHNYNLINDEKYKRLTNRKGFSEEDLEGFIARQIVETSQAVLGVINIFKEIMPDTKIVFSKAKPVSDFRKDEIGWFKSRTLNDYHHAHDAYLNIVVGNVYNTKFTDNPRNFIKKERQKDLNPNYHMNKVFWYNVERGGKVAWIAGEDGTKKTVLKTLAKNSELMTRQSFEQTGGLCNQQITNKDDAGSGIGYLPVKMGEDISKYGGYAKISQSYFFLVEHTFKKKRIRTIETVPAYLKSQIESDPDALKRYCAEKLGLVDPDIRLRRINYQSLAKYNGFYVTICSKTGVRFNIANAVRLTLPKEWNNYIKKLEKTEGDEEITEEKNIELYDILTDKHLNSIFLKRPNPVGENLKNGREKFVSLSKKEQVSTLNNILLFTGFASAGKADISSIGGSKNAGAMAVSKNVNNADEFILIENSVTGIYSVRKDLKTI

SEQ ID NO: 3008 - protein, 1125 aa, Unknown
  Description of Unknown: uncultivated organism sequence
  Category: MG91 effectors
  Description: MG91-200 effector
MKKKILSLDLGITSIGYSILDEMDNDRYALIDYGVSMFDKATDKDGKSKKLLHSASKSSTKLYDLRKSRIRKLANLFEKYGLGKAVELLKQEKENRFTNKWYLRAEKSFTKCLSVNELFSILYLMAKHRGYKSLDTDDLLEELLIELGFDVEEKKEKDAEKGKIKQALKTVESFRKKYPDKTVARIIYEIEIQKENPTFRNHDNYNYMIRREYINEEIAKIVKAQNDFGLFDKSIDIELFIKELILTIDDQKDSTNDMSLFGNCEYYPEHKVAHQYSLLSDIFKMYQSVANITFGKTKISKEQIKIVADDFFKKIKQGKNIGEIKYQDIRKVLKLSDEVQIFGKEDYRLDKKGKKVHHTIIRFHFLSSLGKMDNTFIKSIFKQENKLEILKEIFDVLEFEKAPRSIYKQVNEIFVKYALVDDKKLKDETIINLIKHKSGNSLNISAHAMIQFILYFAKGMTTDEIKKELKLERNEDYSNYMKGIKYLHVKSFEKDDNLEINNHPVKYVVSATMRLVKHLHAMYGAFDEIRVESTRELSQNEETKKAIDKANKEQEKRFQEILGNDEYQKIANHYNKNLKKYARKIMLWEEQEKLDIYSGKVIGFDDIFSNKVDIDHIIPQSLGGLSVKHNLVLAHRDENIKKSNQLPMHFVANKTEYINRVEYLFKEYRINWKKKINLLAETLDERYKDTFESKELRATSYIEALTAQMLKRYYPFPDKQKQANGQAVVHVQGRATSNIRKLLGVKTKVRDTNIHHAIDAILIGLTNKSWLQKLSNTFRENMGVIDDEARANIKKEIPLIEGVEPKELVELIEDAYNVYGEDSVFYKDIFGNTKTVNFWVSKKPMSSKIHKDTIYAKKPNGFFTVREDIIKQFIALKTTVTTDSETFKKNFEKKILQKMYLFKTNSNDVICKVVQSRADEVKNLLDSFVDIDTKNKESMSEAKEKLDSLIRKELLDNNGNVIRKVKFYQSNLKGFDIRGGLAIQEKTFIGFKATLKNKKLGYERIDASNFRKIQKINDGSFKVYKNDVVFFVYEDDNFKGGKIVSFLEDKKMGSFSNPRYPASIKFQPHSFLTLFKGVPNSHKQHSLNKAIGIIKLNLDILGNIKSYSKFGEVSKEVELKIFYKE

SEQ ID NO: 3009 - protein, 523 aa, Unknown
  Description of Unknown: uncultivated organism sequence
  Category: MG91 effectors
  Description: MG91-201 effector
MKSEKKNRCMEKEMFVVELPLKVEKWQSDVLNKRYELIAKIYNYAQKKLLRQYIYLVQMDEYKKCKTKKEKSIFFKNHPFYFKDITSKITFSEYDVTAFVEKIIKKNVSSDKTYKDFGINTSITECIGKHIWSAWEKKIYGNGKKVSLKNKGELNTISIRKKSEYFGGLDIDIEHMILSFNINGKTKSKAKKIILPINVKNLTEYEMYALKDGYDSINVVTIIRKMIRGNYKYYVQFTIEGEKPQKGRTLGNGNVGIDIGPSTVAISSLNGVTIDTLAEKCDNIESKISNIERKMDRSRRATNPQNFTEDGQIKRIDRKKGEKRVWKYSKRYVKLRNKKRELLRKQTVIRKLQHNIKANEILSLGDTFIVENNPISAWAKRANGVRKNKNGKIQTNKRFGKSIGNHAPAMFVTILQNKVESLKGKFVQVDLKNAASRFDFTNGDFTEHNLDERKITLSNGNTHQRDMLAAFNLQHIDLTNDDLKKYNVDEMIEDYPIFCKLEKEEIKRFIDKMKISNKSNIGL

SEQ ID NO: 3010 - protein, 510 aa, Unknown
  Description of Unknown: uncultivated organism sequence
  Category: MG91 effectors
  Description: MG91-202 effector
MFVVELPLKVEKWQSDVLNKRYELIAKIYNYAQKKLLRQYIYLVQMDEYKKCKTKKEKSIFFKNHPFYFKDITSKITFSEYDVTAFVEKIIKKNVSSDKTYKDFGINTSITECIGKHIWSAWEKKIYGNGKKVSLKNKGELNTISIRKKSEYFGGLDIDIEHMILSFNINGKTKSKAKKIILPINVKNLTEYEMYALKDGYDSINVVTIIRKMIRGNYKYYVQFTIEGEKPQKGRTLGNGNVGIDIGPSTVAISSLNGVTIDTLAEKCDNIESKISNIERKMDRSRRATNPQNFTEDGQIKRIDRKKGEKRVWKYSKRYVKLRNKKRELLRKQTVIRKLQHNIKANEILSLGDTFIVENNPISAWAKRANGVRKNKNGKIQTNKRFGKSIGNHAPAMFVTILQNKVESLKGKFVQVDLKNAASRFDFTNGDFTEHNLDERKITLSNGNTHQRDMLAAFNLQHIDLTNDDLKKYNVDEMIEDYPIFCKLEKEEIKRFIDKMKISNKSNIGL

SEQ ID NO: 3011 - protein, 514 aa, Unknown
  Description of Unknown: uncultivated organism sequence
  Category: MG91 effectors
  Description: MG91-203 effector
MEKEMFVVELPLKVEKWQSDVLNKRYELIAKIYNYAQKKLLRQYIYLVQMDEYKKCKTKKEKSIFFKNHPFYFKDITSKITFSEYDVTAFVEKIIKKNVSSDKTYKDFGINTSITECIGKHIWSAWEKKIYGNGKKVSLKNKGELNTISIRKKSEYFGGLDIDIEHMILSFNINGKTKSKAKKIILPINVKNLTEYEMYALKDGYDSINVVTIIRKMIRGNYKYYVQFTIEGEKPQKGRTLGNGNVGIDIGPSTVAISSLNGVTIDTLAEKCDNIESKISNIERKMDRSRRATNPQNFTEDGQIKRIDRKKGEKRVWKYSKRYVKLRNKKRELLRKQTVIRKLQHNIKANEILSLGDTFIVENNPISAWAKRANGVRKNKNGKIQTNKRFGKSIGNHAPAMFVTILQNKVESLKGKFVQVDLKNAASRFDFTNGDFTEHNLDERKITLSNGNTHQRDMLAAFNLQHIDLTNDDLKKYNVDEMIEDYPIFCKLEKEEIKRFIDKMKISNKSNIGL

SEQ ID NO: 3012 - protein, 523 aa, Unknown
  Description of Unknown: uncultivated organism sequence
  Category: MG91 effectors
  Description: MG91-204 effector
MKSEKKNRCMEKEMFVVELPLKVEKWQSDVLNKRYELIAKIYNYAQKKLLRQYIYLVQMDEYKKCKTKKEKSIFFKNHPFYFKDITSKITFSEYDVTAFVEKIIKKNVSSDKTYKDFGINTSITECIGKHIWSAWEKKIYGNGKKVSLKNKGELNTISIRKKSEYFGGLDIDIEHMILSFNINGKTKSKAKKIILPINVKNLTEYEMYALKDGYDSINVVTIIRKMIRGNYKYYVQFTIEGEKPQKGRTLGNGNVGIDIGPSTVAISSLNGVTIDTLAEKCDNIESKISNIERKMDRSRRATNPQNFTEYGQIKRIDRKKGEKRVWKYSKRYVKLRNKKRELLRKQTVIRKLQHNIKANEILSLGDTFIVENNPISAWAKRANGVRKNKNGKIQTNKRFGKSIGNHAPAMFVTILQNKVESLKGKFVQVDLKNAASRFDFTNGDFTEHNLDERKITLSNGNTHQRDMLAAFNLQHIDLTNDDLKKYNVDEMIEDYPIFCKLEKEEIKRFIDKMKISNKSNIGL

SEQ ID NO: 3013 - protein, 1353 aa, Unknown
  Description of Unknown: uncultivated organism sequence
  Category: MG91 effectors
  Description: MG91-205 effector
MAVFKYYLGLDMGTNSVGWAVTDIQYNILKVKGKDLWGIREFNEASTAVERRTHRVSRRARQRKTVLIGLLKYYFHDEICKKDPYFFQRLDNSKYHLEDKDDEVKCTYNIFNDINYTDADYFKQYPTIFHLRNELIINPNEHDIRLVYLALLNMFKHRGHFLNDSLIDDGSEMKIDEAYLELANLLSEYTEYYLKTDVNITELENILSDRDESRTKKSEKIVELLEIDSKNKPYKEMIRGLCGLKFNAITIFSDVQLEDGQKLDICLSDASFEEKADDIASILGEDYFQIILSMKRLYDIGSLSEIMKGYSYLSEARVASYKKHKEDLCCLKRVIKKYCNKECYEKIFNSDEDGSYASYVGSFNSNSKQRRVGNKRSIEDLYKEIKKILKAVPQEDADVQRILTSIDNETFLPKQLTASNGVIPNQIHEKEMKKILSNAENYLPFLKEKDEKNQTVSERILMLFTFRIPYYVGPTTENSQKNGGNGWVIRKEAGQVLPWNIEEKIDMKATSEAFISRMIRRCTYISGKPVLPRASLEYQSFCVLNAINNITIDGYRISVELKQDIYNDLFLKGKKVTKKQLCKYLYLRGLITSENQVSGIDIEINNTLSTYKIFKNIFGDDIIYDRTKIMIEDIVFWCTVYGESKKFLRERLCEKYGDKLSQDQIKRILGLKFKDWGNLSKEFLELSGVNKKTNESMSIIKALWENNLNMMELINSDLFDFKEKIVEYQTDLMKTIYNIEVDDLENYYFSAPVKRMVWQTILVVKELVGVLGCEPTRIFIEMTRRHDEITKRTINRKKKFEALYKSVKDEDTDWMNVIADADDTGRIRSKKMYLYLTQKGRCMYTGKHIELSDLFNNNLYDIDHIYPRHFVKDDNIDNNLVLVCKEKNAHKRDIYPLEEQIYSSQKGMWSELKKLGFINEEKYNRLTGRNSFTDEQKAGFIARQLVETSQGTKGVANILQQLLPESKIVYAKASNVSEFRQSRDIPKSRLVNEFHHAHDAYLNIVVGNVYYVKFTQDPLKFIRNDYDKDKINNNYNLSKMFDWDVKRKGEVAWIAQKKNGDVGTIATVKKVLSKNTPLMTRYCFEGRGKISKEERHSAKKAKQVGYLPYKTSDLKIKDVTKYGGFTSITVAYYFVVEHDEKKKRIRTIESVPLYLAAKINSNHEELDKYCKNELGLVNFNIRVRKIRIGSLLKQNGYFFYITGKTGNRLIVRNAVNICFRKEWIKYSSKIEKYQEKKIIDDIITKDKNELFYDEFIKKYENSIFANRPNSILEKLKKAFPVFKESNIEQQCSILYQLLNLSKILGSECDLRLIGESPNCGKMLINKKIGDDDIYLINQSVTGLYENKINLRTV

SEQ ID NO: 3014 - protein, 1352 aa, Unknown
  Description of Unknown: uncultivated organism sequence
  Category: MG91 effectors
  Description: MG91-206 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNREFPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3015 - protein, 1352 aa, Unknown
  Description of Unknown: uncultivated organism sequence
  Category: MG91 effectors
  Description: MG91-207 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLTSNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3016 - protein, 1352 aa, Unknown
  Description of Unknown: uncultivated organism sequence
  Category: MG91 effectors
  Description: MG91-208 effector
MLEKPYYLGLDMGTNSVGWAVTDQHYNLLKAKGKDLWGIREFTEADTSVERRTHRISRRRRQREQARIGLLNDYFHDAIIAIDPSFFQRLENSKYHLEDKDQNVRYKYNIFNDPDYTDVDYYVQYPTIYHLRKELLENPKPHDVRLVYLALLNMFKRRGHFLNAGISDGNNERSLKDAYINFAISVSELTEDYFNQDVDYSAIEEILSSRDLNRTKKAEELSTVLGIDFKNKKYKEYLRAICGLKINAYTLFSDQLPDDTTKIDLCVSDASFEEKSEELVSLIGEDLFQIILNIKEIYDIGSLTGILKGYTYLSQARVATYDKHKHDLKLLKSSIKKYCTKEEYNNFFNSDADGSYASYIGSFNSGNKKRRVGSKRTSEDLYKEIKKLLKDANKSDPAINEIFTSIETESFLPKQLTASNGIIPNQVHSKEMAKILSNAENYLPFLKDTDENNLSISNRILQLYKFQIPYYIGPVTEKSQRDGGNGWVIRKDNGRVLPWNIEEKIDVKATSETFISRMVRRCTYMNGKQVLPKASLEYESFRVLNEINNLRIDGERIPVALKQDIYTDLFQKGKKVTKKQLCNYLVTRGLIESSEQVTGIDIAINNSLSTYGKFKAILGEDIKLDHIQHMIEDIVFWCTVYGDSKQFLKEQIEDKYKEKLSPEQMKRILGFKFKDWGNLSKEFFELKGADKSTGEAISIIRALWENNLNLMELINSPEFDFKERLTDYQTNSLKTLSDFEPEDLNEYYFSAPVRRMIWQTTSIIKELVHVLGKEPARIFIEMTREKDASRGRTLSRKKKFEDLYKNVKDENTDWAKVIEHADESGTIRSKKMYLYLTQKGKCMYTGKHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMDKNNYNLSRMFDWDVKRGDEVAWIAQKKDGTAGTISTVKKMLSKNTPLMTRLSYEGKGALANETLYSAEKAKGEGYIPFKSSDAKIQDVTKYGGFTSVTGAYFFLVEHDEKKKRIRTIESVPLYLADRIDKDSSELERYCDKLGLVNYDIRVRKIKIGSLINRNGYFAYLTGKTGKQLILRNATSLCLDKKWTIYIKKIEKYKETKVLDSIITSETTVNLYNELLNKFTVGIYGRRPNPIGEKMDSARDKFASLSIENQCLALYQILQLSAILGNESDLQLIGASTHAGKMLISRKIGTDEIYLINQSPTGLFETKIDLQTI

SEQ ID NO: 3017 - protein, 1359 aa, Unknown
  Description of Unknown: uncultivated organism sequence
  Category: MG91 effectors
  Description: MG91-209 effector
MLNTPYYLGLDMGTNSVGWAVTDKNYNLLRAKGKDLWGIREFSDSATSVDRRSYRIRRRRRQREQARIGLLKYYFNDSIIAKDPSFFQRLENSKYHLEDKDEAVKYKFNIFNDKTYTDIDYYTQYPTIYHLRKELLESSEPHDVRLVYLALLNMFKHRGHFLNAEIGDVAEERKLKDAYIDFCSCVSELTNESFNLDIDYSAVEEILSSRDISRTKKSEALASILNIDVKNKKYKEYVKAICGLKVNAYTLFSEQLSDEVKRIDICVSDASFDTKREDYISILGEDLFQIILYIKEIYDIGSLAGILKGYSYLSFARVATYEKHKSDLRKLKDCIRKYCSKEDYNQFFNSDAAGFYASYIGSFNSGKKQRRVGKNTTSEDLYKEIKKILKNADKNDPAIIDIFSSIDTESFLPKQLTASNGVIPNQVHYKEMAKILSNAESYLPFLREKNESNLSVSERILQIYKFQIPYYIGPVTEKSHRDGGNGWVIRKSNGRVLPWNINEKIDVKATSEAFISRMVRRCTYMNGAQVLPKASLEYESFRVLNEINNLRIDGERIPVDLKQAIYIDIFQKGKKITADILHKYLFNKGYIQSSEQVTGIDININNSLSTYGKFKVIFGEDIKLDSVQHMIEDIVFWCTVYGDSKKFLQEQIEEKYSDKISKEQLKRILGFKFKDWGSLSKEFFELKATDKSTGENISIIRALWENNLNLMELINSSKFNFKERLEEYRITSLKTLSDFEPEDLREYYFSAPVRKMIWQTMLVIKELVHVLGHEPERIFIEIPRDKDPSIGRTISRKKKFEELYKNVKDESVDWMNVIEHADDSGSLRSKKMYLYLTQKGRCMYTGEHIELSDLFNKSLYDIDHIYPRHFVKDDNIDNNLVLVKREKNAHKSDNYPLEAEIFNNQKKMWAQLRKEDFINEEKYKRLMGRNPFTDEQKAGFIARQLVETQQGTKGVAELLQQLLPNSKIVYTKAGNVSDFRHSREIPKSRLINDFHHAHDAYLSIVVGNVYYVKFTQNPINFIKNAYNKDSSKNNYNLTRMFDWDVKRRDEVAWIAQNKNGTVGTIAIVKKMLKRNTPLMTRLSYEGKGGLTKETLYSAEKAKGEGYIPFKSSDKKMQDVTKYGGFTSVKGAYFFLVEHDEKKKQIRTIESVPLYLADKIEKDPAELERYCQKLGLVNYNIRVRKIKIGTLIKRNGYFAYLTGKTGKQLILRNATNLCLDSKWGTYIKKIEKYKDTGVLDNTLDTDTNIKLYNELLDKFTTGIYGKRPNPIGDKMLSAKNTFTSFTLDNQCNLIYQILQLSKILGFETDLSLLHTNKKSDKPTREGGMQISKKVSNTTSMYLINQSPTGLFEKQIDLLTV

SEQ ID NO: 3018 - protein, 1352 aa, Unknown
  Description of Unknown: uncultivated organism sequence
  Category: MG91 effectors
  Description: MG91-210 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDITINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNREFPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKRIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3019 - protein, 1359 aa, Unknown
  Description of Unknown: uncultivated organism sequence
  Category: MG91 effectors
  Description: MG91-211 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGATGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDIRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3020 - protein, 1352 aa, Unknown
  Description of Unknown: uncultivated organism sequence
  Category: MG91 effectors
  Description: MG91-212 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGESVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLTSNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3021 - protein, 1352 aa, Unknown
  Description of Unknown: uncultivated organism sequence
  Category: MG91 effectors
  Description: MG91-213 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIDDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLTSNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3022 - protein, 1359 aa, Unknown
  Description of Unknown: uncultivated organism sequence
  Category: MG91 effectors
  Description: MG91-214 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVCAKAGNVSDFRRNRELPKSRLVNDFHHAHDAYLNIVVGNVYYVKFTQNPINYIKNSYNKDMNKNNYNLSRMFDWDVKRGDEVAWIAQKQDGATGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDIRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3023 - protein, 1147 aa, Unknown
  Description of Unknown: uncultivated organism sequence
  Category: MG91 effectors
  Description: MG91-215 effector
MSRTRKAEGLAEILGVDYKNKPYKELIRGLCGLKFNACAIFPEIQSDEVPKLDICLSEASFDEKSDEIANILGEDYFEIIMAMKDIYDIGSLAGIRKGYNYLSQARVASYERHKEDLKLLKEVIKKYCSKDDYDSFFNSDADGSYASYVGSYNSKTKQRRVGNKRSSEELYKAIKKLFKNVPVEDADVQSILTSIENETFLPKQLTVSNGVIPNQVHAEEMKKILSNAENYLPFLKEKDETGLSVSEKILKLFSFQIPYYVGPTTEKSNKDGGNGWVVRKEEGQVLPWNIDEKIDMKATSEAFISRMVRRCTYISGELVLPKSSLEYQSFCVLNEINNIKIDGERISVELKQDIYKEVFQKGKRVTKKQLCKYLHTRGIIEAEEQVTGIDVTINNALTTYGKFKAILGDDISKDSVQKMIEDIVFWCTVYGDSKKFLKDRIEEKYGEKLTKEQIKRIIGFKFKDWGNLSKNFLELSGADVSTGESVSIIRALWNDNLNLMELINSRLYNYKERLAECQNTMMKTLSDIEAEDLDEYYFSAPVKRMIWQTILIIKELVKVLGCEPDRIFVEMTRRPDERKMRTESRRKKFEELYKKVKDEDVDWMKVIAHADETGSIRSKKMYLYLTQKGRCMYTGKHIELSDLFNNNLYDIDHIYPRHFVKDDNIDNNLVLVCKEKNAHKSDIYPLEDEILASQKNMWSELRRSELRRSGFITEEKYNRLIGRNPFTDEQKAGFIARQLVETSQGTKGVANILQQLLPESKIVYAKASNVSEFRNTRDIPKSRLINEFHHAHDAYLNIVVGNVYYVKFTQNPLNFIKNDYDRDKTKNNYNLSKMFDWDVERNGEVAWIAQKKDGEAGTIATVKKVLERNTPLMTRYSFEKKGRLTKEERHSAIDAKKDQYLPFKTSDSKMQDVTKYGGFNDIAGTYFFLVEHTEKKNRIRTIESVPLYIAKKIDQNPIELEKYCEQVLGLVDFDIRVRKIKIGSLIKRNNYFCYITGKKPGRLIVRNAVNLCLKNEWIKYISKLEKYNEKNVIDEMITKEKNQLLYLELINKFRNSIFSKRPNGIGKKLEDARNIFNDLSTEEQCIVLYKVLQLSAVMGYEADLSLIKYSKSAGAMQISKKIGDEDIYLINQSVTGLYEKKINLRTV

SEQ ID NO: 3024 - protein, 1359 aa, Unknown
  Description of Unknown: uncultivated organism sequence
  Category: MG91 effectors
  Description: MG91-216 effector
MIEKPYYLGLDMGTNSVGWAVTDQHYNLLKAKGKDLWGIREFTEADTSVERRTHRISRRRRQREQARIGLLNDYFHDAIIAIDPSFFQRLENSKYHLEDKDQNVRYKYNIFNDPDYTDVDYYTQYPTIYHLRKELLENPKPHDIRLVYLALLNMFKRRGHFLNAAISDGNNERSLKDAYINFAISVSELTEDYFNQDVDYSAIEEILSSRDLNRTKKAEELSTVLGIDFKNKKYKEYLRAICGLKINAYTLFSEQLPDDTTKIDICVSDASFDEKSEELVSLIGEDLFQIILNIKEIYDIGSLTGILKGYTYLSQARVAAYDKHKHDLKLLKSSIKKYCTKEEYNNFFNSDADGSYASYIGSFNSGNKERRVGSKRTSEDLYKEIKKILKDANKNDPVINEIFTSIETESFLPKQLTASNGIIPNQVHSKEMAKILANAENYLPFLKDTDENNLSISNRILQLYKFQIPYYIGPVTEKSQRDGGNGWVIRKDNGHVLPWNIEEKIDVKATSEAFISRMVRRCTYMNGKQVLPKASLEYESFRVLNEINNLRIDGERIPVALKQDIYTDLFQKGKKVTKKQLCNYLVTRGLIESSEQVTGIDIAINNSLSTYGKFKAILGEDIKLDHIQHMIEDIVFWCTVYGDSKQFLKEQIEDKYKEKLSPEQMKRILGFKFKDWGNLSKEFFELKGADKSTGEAISIIRALWENNLNLMELINSPEFDFKERLADYETNSLKTLSDFEPEDLNEYYFSAPVRRMIWQTTLIIKELVHVLGKEPARIFIEMTREKDTSRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEAAWIAQKKDGTAGTISTVKKMLSKNTPLMTRLSYEGKGALANETLYSAKKAKEEGYIPFKSSDAKIQDVTKYGGFTSVTGAYFFLVEHDEKKKRIRTIESVPLYLANKIEKDSSELERYCDKLGLVNYDIRVRKIKIGTLIKYNGYFCYITGKTGYRLIVRNATNLCLASNWTKYIKKIEKYKETTIIDNVITAEENIKLYNELLNKFTVGIFGRRPNPIGEKMDSAKNTFTSYTLDNQCNLIYQILQLSKILGFETDLSLLRTNKQFGKPTREGGMQISKKINNTTSMYLINQSPTGLFETKIDLQTI

SEQ ID NO: 3025 - protein, 1352 aa, Unknown
  Description of Unknown: uncultivated organism sequence
  Category: MG91 effectors
  Description: MG91-217 effector
MLEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDVDYYAQYPTIYHLRKELLENPKPHDVRLVYLALLNMFKRRGHFLNAGISDGNNERSLKDAYINFAISVSELTEDYFNQDVDYSAIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKRKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWVAQKQDAAAGTISTVKKMLSKNTPLMTRLSYEGKGALANETLYSAEKAKGEGYIPFKSSDAKIQDVTKYGGFTSVTGAYFFLVEHDEKKKRIRTIESVPLYLADKIDKDSLELERYCDKLGLVNYDVRVRKIKIGSLLNRNGYFAYLTGKTGKQLILRNATNLCLDKKWTIYIKKIEKYKETNVLDSIITSETMVNLYNELLNKFTVGIYGRRPNPIGEKMNSARDKFASLSIENQCLALYQILQLSAILGNESDLQLIGASTHAGKMLISKKIGTDEIYLINQSPTGLFETKIDLQTI

SEQ ID NO: 3026 - protein, 1359 aa, Unknown
  Description of Unknown: uncultivated organism sequence
  Category: MG91 effectors
  Description: MG91-218 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRYFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGATGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDIRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3027 - protein, 1358 aa, Unknown
  Description of Unknown: uncultivated organism sequence
  Category: MG91 effectors
  Description: MG91-219 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTLYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAHVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3028 - protein, 1332 aa, Unknown
  Description of Unknown: uncultivated organism sequence
  Category: MG91 effectors
  Description: MG91-220 effector
MLNTPYYLGLDMGTNSVGWAVTDKNYNLLRAKGKDLWGIREFSDSATSVDRRSYRIRRRRRQREQARIGLLKYYFNDSIIAKDPSFFQRLENSKYHLEDKDEAVKYKFNIFNDKTYTDIDYYTQYPTIYHLRKELLESSEPHDVRLVYLALLNMFKHRGHFLNAEIGDVAEERKLKDAYIDFCSCVSELTNESFNLDIDYSAVEEILSSRDISRTKKSEALASILNIDVKNKKYKEYVKAICGLKVNAYTLFSEQLSDEVKRIDICVSDASFDTKREDYISILGEDLFQIILYIKEIYDIGSLAGILKGYSYLSFARVATYEKHKSDLRKLKDCIRKYCSKEDYNQFFNSDAAGFYASYIGSFNSGKKQRRVGKNTTSEDLYKEIKKILKNADKNDPAIIDIFSSIDTESFLPKQLTASNGVIPNQVHYKEMAKILSNAESYLPFLREKNESNLSVSERILQIYKFQIPYYIGPVTEKSHRDGGNGWVIRKSNGRVLPWNINEKIDVKATSEAFISRMVRRCTYMNGAQVLPKASLEYESFRVLNEINNLRIDGERIPVDLKQAIYIDIFQKGKKITADILHKYLFNKGYIQSSEQVTGIDININNSLSTYGKFKVIFGEDIKLDSVQHMIEDIVFWCTVYGDSKKFLQEQIEEKYSDKISKEQLKRILGFKFKDWGSLSKEFFELKATDKSTGENISIIRALWENNLNLMELINSSKFNFKERLEEYRITSLKTLSDFEPEDLREYYFSAPVRKMIWQTMLVIKELVHVLGHEPERIFIEIPRDKDPSIGRTISRKKKFEELYKNVKDESVDWMNVIEHADDSGSLRSKKMYLYLTQKGRCMYTGEHIELSDLFNKSLYDIDHIYPRHFVKDDNIDNNLVLVKREKNAHKSDNYPLEAEIFNNQKKMWAQLRKEDFINEEKYKRLMGRNPFTDEQKAGFIARQLVETQQGTKGVAELLQQLLPNSKIVYTKAGNVSDFRHSREIPKSRLINDFHHAHDAYLSIVVGNVYYVKFTQNPINFIKNAYNKDSSKNNYNLTRMFDWDVKRRDEVAWIAQNKNGTVGTIAIVKKMLKRNTPLMTRLSYEGKGGLTKETLYSAEKAKGEGYIPFKSSDKKMQDVTKYGGFTSVKGAYFFLVEHDEKKKQIRTIESVPLYLADKIEKDPAELERYCQKLGLVNYNIRVRKIKIGTLIKRNGYFAYLTGKTGKQLILRNATNLCLDSKWGTYIKKIEKYKDTGVLDNTLDTDTNIKLYNELLDKFTTGIYGKRPNPIGDKMLSAKNTFTSFTLDNQCNLIYQILQLSKILGFETDLSLLHTNKKSDKPTREGGMQISKK

SEQ ID NO: 3029 - protein, 1352 aa, Unknown
  Description of Unknown: uncultivated organism sequence
  Category: MG91 effectors
  Description: MG91-221 effector
MTAFKYYLGLDMGTNSVGWAATDPEYRLLKAKGKDLWGIREFNEASGAVERRTHRISRRRRQREQVRIGILKDYFHDAICEVDPGFFRRLENSKYHEEDKDVEVRYKNNIFNDRNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3030 - protein, 1358 aa, Unknown
  Description of Unknown: uncultivated organism sequence
  Category: MG91 effectors
  Description: MG91-222 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAHVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3031 - protein, 1352 aa, Unknown
  Description of Unknown: uncultivated organism sequence
  Category: MG91 effectors
  Description: MG91-223 effector
MTAFKYYLGLDMGTNSVGWAATDPEYRLLKAKGKDLWGIREFNEASGAVERRTHRISRRRKQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRSPFSDEKKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDTVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3032 - protein, 1352 aa, Unknown
  Description of Unknown: uncultivated organism sequence
  Category: MG91 effectors
  Description: MG91-224 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNVYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3033 - protein, 1352 aa, Unknown
  Description of Unknown: uncultivated organism sequence
  Category: MG91 effectors
  Description: MG91-225 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNVYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIQRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRNPFSDEQKAGFIARQLVETSQGTKGVANILRQLLPGSKIVYAKASNVSEFRRTRDDIPKSRLVNDFHHAHDAYLNIVVGNVYYVKFTQNPLNFIKKDYDNYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTSVTGAYFFLVEHAEKKKRIRTIESVPVYLAQKIEQNPDELKKYCEEILGLIDADIRLKKIKIGSLIKRNGYFCYITGKTGKQLIVRNAVNLCLKNEWIKYISKLEKVKEKDAVDKIITKEKNEVLYSELIQKFKHGIFSKRPNPVGDKLEKGSEKFSNLSIKEQCTVLCQILQLAAVLGSECDMTLLGESAHCGKMLISKKIGDEEIYLINQSVTGLYEKKINLHTV

SEQ ID NO: 3034 - protein, 1352 aa, Unknown
  Description of Unknown: uncultivated organism sequence
  Category: MG91 effectors
  Description: MG91-226 effector
MTAFKYYLGLDMGTNSVGWAATDPEYRLLKAKGKDLWGIREFNEASGAVERRTHRISRRRRQREQVRIGILKDYFHDAICEVDPGFFRRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLINQSVTGLYEKKINLHTV

SEQ ID NO: 3035 - protein, 1352 aa, Unknown
  Description of Unknown: uncultivated organism sequence
  Category: MG91 effectors
  Description: MG91-227 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQEVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAILGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNEYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWVAQKQDAAAGTISTVKKMLSKNTPLMTRLSYEGKGALANETLYSAEKAKGEGYIPFKSSDAKIQDVTKYGGFTSVTGAYFFLVEHDEKKKRIRTIESVPLYLADKIDKDSSELERYCDKLGLVNYDVRVRKIKIGSLLNRNGYFAYLTGKTGKQLILRNATNLCLDKKWTIYIKKIEKYKETNVLDSIITSETMVNLYNELLNKFTVGIYGRRPNPIGEKMNSARDKFASLSIENQCLALYQILQLSAILGNESDLQLIGASTHAGKMLISKKIGTDEIYLINQSPTGLFETKIDLQTI

SEQ ID NO: 3036 - protein, 1358 aa, Unknown
  Description of Unknown: uncultivated organism sequence
  Category: MG91 effectors
  Description: MG91-228 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGFITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNLSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGAAISGKMLISKNITDAKECLLINQSVTGLYENRIDLLRV

SEQ ID NO: 3037 - protein, 1352 aa, Unknown
  Description of Unknown: uncultivated organism sequence
  Category: MG91 effectors
  Description: MG91-229 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIDDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNREFPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3038 - protein, 1352 aa, Unknown
  Description of Unknown: uncultivated organism sequence
  Category: MG91 effectors
  Description: MG91-230 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3039 - protein, 1359 aa, Unknown
  Description of Unknown: uncultivated organism sequence
  Category: MG91 effectors
  Description: MG91-231 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3040 - protein, 1359 aa, Unknown
  Description of Unknown: uncultivated organism sequence
  Category: MG91 effectors
  Description: MG91-232 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3041 - protein, 1352 aa, Unknown
  Description of Unknown: uncultivated organism sequence
  Category: MG91 effectors
  Description: MG91-233 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNVYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3042 - protein, 1359 aa, Unknown
  Description of Unknown: uncultivated organism sequence
  Category: MG91 effectors
  Description: MG91-234 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKREDEVAWIAQKQDGATGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDIRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3043 - protein, 1352 aa, Unknown
  Description of Unknown: uncultivated organism sequence
  Category: MG91 effectors
  Description: MG91-235 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVTGAYFFLVEHTEKKKRIRTIESVPVYFVQKIEKNPGELKKYCEEILGLVDADIRLKKIKIGSLIKRNGYFCYITGKTGNRLSVRNAVNLCLKNEWIKYISKLEKVKEKDTIDEIITKEKNEVLYSELIQKFKHCIFSKRPNPVGDKLEKGSEKFSNLSIKDQCAVLCQVLRMAAILGSECDMTLLGESSICGEMKISKKIGDEEIYLINQSVTGLYEKKINLHTV

SEQ ID NO: 3044 - protein, 1358 aa, Unknown
  Description of Unknown: uncultivated organism sequence
  Category: MG91 effectors
  Description: MG91-236 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVIDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3045 - protein, 1353 aa, Unknown
  Description of Unknown: uncultivated organism sequence
  Category: MG91 effectors
  Description: MG91-237 effector
MAVFKYYLGLDMGTNSVGWAVTDIQYNILKVKGKDLWGIREFNEASTAVERRTHRVSRRARQRKTVLIGLLKYYFHDEICKKDPYFFQRLDNSKYHLEDKDDEVKYTYNIFNDINYTDADYFKQYPTIFHLRNELIFNPNEHDIRLVYLALLNMFKHRGHFLNDSLIDDDSEMKIDEAYLELANLLSEYTEYYLKTDVNITELENILSDRDESRTKKSEKIVELLEIDSKNKPYKEMIRGLCGLKFNAITIFSDVQLEDGQKLDICLSDASFEEKADEIASILGEDYFQIILSMKRLYDIGSLSEIMKGYSYLSEARVASYKKHKEDLCCLKRVIKKYCNKECYEKIFNSDEDGSYASYVGSFNSNSKQRRVGNKRSIEDLYKEIKKILKAVPQEDADVQRILTSIDNETFLPKQLTASNGVIPNQIHEKEMKKILSNAENYLPFLKEKDEKNQTVSERILMLFTFRIPYYVGPTTENSQKNGGNGWVIRKEAGQVLPWNIEEKIDMKATSEAFISRMIRRCTYISGKPVLPRASLEYQSFCVLNAINNITIDGYRISVELKQDIYNDLFLKGKKVTKKQLCKYLYLRGLITSENQVSGIDIEINNTLSTYKIFKNIFGDDIIYDSTKIMIEDIVFWCTVYGESKKFLRERLCEKYGDKLSQDQIKRILGLKFKDWGNLSKEFLELSGVNKKTNESMSIIKALWENNLNMMELINSDLFDFKEKIVEYQTDLMKTIYNIEVDDLENYYFSAPVKRMVWQTILVVKELVGVLGCEPTRIFIEMTRRHDEITKRTINRKKKFEALYKSVKDEDTDWMNVIADADDTGRIRSKKMYLYLTQKGRCMYTGKHIELSDLFNNNLYDIDHIYPRHFVKDDNIDNNLVLVCKEKNAHKRDIYPLEEQIYSSQKEMWSELKKLGFINEEKYNRLTGRNSFTDEQKAGFIARQLVETSQGTKGVANILQQLLPESKIVYAKASNVSEFRQSRDIPKSRLVNEFHHAHDAYLNIVVGNVYYVKFTQDPLKFIKNDYDKDKINNNYNLSKMFDWDVKRKGEVAWIAQKKNGDVGTIATVKKVLSKNTPLMTRYCFEGRGKISKEERHSAKEAKQVGYLPYKTSDLKIKDVTKYGGFTSITVAYYFVVEHDEKKKRIRTIESVPLYLAAKINSNHEELDKYCKNELGLVNFNIRVRKIRIGSLLKRNGYFFYITGKTGNRLIVRNAVNICFRKEWIKYSSKIEKYQEKKIIDDIITKDKNELFYDEFIKKYENSIFANRPNSILEKLKKAFPVFKESNIEQQCSILYQLLNLSKILGSECDLRLIGESPNCGKMLINKKIGDDDIYLINQSVTGVYENKINLRTV

SEQ ID NO: 3046 - protein, 1352 aa, Unknown
  Description of Unknown: uncultivated organism sequence
  Category: MG91 effectors
  Description: MG91-238 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGKNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNTDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLTSNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3047 - protein, 1358 aa, Unknown
  Description of Unknown: uncultivated organism sequence
  Category: MG91 effectors
  Description: MG91-239 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRIVKKYFEPTIYDKLFRSEENGTYSAYVNSFNSEEKSRRNYKVRKQEDLYNSIKKLLKSVDNVYDTDIEYIKNEMDKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSISGERIAVALKQDLYNTLFLKGKRVTRKQIFNYFHSRGLVEEDSQISGIDIAVNNSLSTYGKFLPLFGDHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCGETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3048 - protein, 1358 aa, Unknown
  Description of Unknown: uncultivated organism sequence
  Category: MG91 effectors
  Description: MG91-240 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVTGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSGEKSRRNYKERKQEDLYNSIKKLLKSIDNVCDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMIWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3049 - protein, 1352 aa, Unknown
  Description of Unknown: uncultivated organism sequence
  Category: MG91 effectors
  Description: MG91-241 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGATGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3050 - protein, 1352 aa, Unknown
  Description of Unknown: uncultivated organism sequence
  Category: MG91 effectors
  Description: MG91-242 effector
MTAFKYYLGLDMGTNSVGWAATDPEYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTIHVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3051 - protein, 1358 aa, Unknown
  Description of Unknown: uncultivated organism sequence
  Category: MG91 effectors
  Description: MG91-243 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGAAISGKMLISKNITDAKECLLINQSVTGLYENRIDLLRV

SEQ ID NO: 3052 - protein, 1352 aa, Unknown
  Description of Unknown: uncultivated organism sequence
  Category: MG91 effectors
  Description: MG91-244 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3053 - protein, 1352 aa, Unknown
  Description of Unknown: uncultivated organism sequence
  Category: MG91 effectors
  Description: MG91-245 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3054 - protein, 1352 aa, Unknown
  Description of Unknown: uncultivated organism sequence
  Category: MG91 effectors
  Description: MG91-246 effector
MTAFKYYLGLDMGTNSVGWAATDPGYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCSKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIELVPVYLAQKIEQNPDELKKYCEEILGLIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3055 - protein, 1352 aa, Unknown
  Description of Unknown: uncultivated organism sequence
  Category: MG91 effectors
  Description: MG91-247 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNDYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3056 - protein, 1352 aa, Unknown
  Description of Unknown: uncultivated organism sequence
  Category: MG91 effectors
  Description: MG91-248 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHAEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3057 - protein, 1352 aa, Unknown
  Description of Unknown: uncultivated organism sequence
  Category: MG91 effectors
  Description: MG91-249 effector
MTAFKYYLGLDMGTNSVGWAATDPEYRLLKAKGKDLWGIREFNEASGAVERRTHRISRRRRQREQVRIGILKDYFHDAICEVDPGFFRRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVTGAYFFLVEHTEKKKRIRTIESVPVYFVQKIEKNPGELKKYCEEILGLVDADIRLKKIKIGSLIKRNGYFCYITGKTGNRLSVRNAVNLCLKNEWIKYISKLEKVKEKDTIDEIITKEKNEVLYSELIQKFKHCIFSKRPNPVGDKLEKGSEKFSNLSIKDQCAVLCQVLRMAAILGSECDMTLLGESSICGEMKISKKIGDEEIYLINQSVTGLYEKKINLHTV

SEQ ID NO: 3058 - protein, 1352 aa, Unknown
  Description of Unknown: uncultivated organism sequence
  Category: MG91 effectors
  Description: MG91-250 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCKEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3059 - protein, 1353 aa, Unknown
  Description of Unknown: uncultivated organism sequence
  Category: MG91 effectors
  Description: MG91-251 effector
MAVFKYYLGLDMGTNSVGWAVTDIQYNILKVKGKDLWGIREFNEASTAVERRTHRVSRRARQRKTVLIGLLKYYFHDEICKKDPYFFQRLDNSKYHLEDKDDEVKYTYNIFNDINYTDADYFKQYPTIFHLRNELIFNPNEHDIRLVYLALLNMFKHRGHFLNDSLIDDDSEMKIDEAYLELANLLSEYTEYYLKTDVNITELENILSDRDESRTKKSEKIVELLEIDSKNKPYKEMIRGLCGLKFNAITIFSDVQLEDGQKLDICLSDASFEEKADEIASILGEDYFQIILSMKRLYDIGSLSEIMKGYSYLSEARVASYKKHKEDLCCLKRVIKKYCNKECYEKIFNSDEDGSYASYVGSFNSNSKQRRVGNKRSIEDLYKEIKKILKAVPQEDADVQRILTSIDNETFLPKQLTASNGVIPNQIHEKEMKKILSNAENYLPFLKEKDEKNQTVSERILMLFTFRIPYYVGPTTENSQKNGGNGWVIRKEAGQVLPWNIEEKIDMKATSEAFISRMIRRCTYISGKPVLPRASLEYQSFCVLNAINNITIDGYRISVELKQDIYNDLFLKGKKVTKKQLCKYLYLRGLITSENQVSGIDIEINNTLSTYKIFKNIFGDDIIYDSTKIMIEDIVFWCTVYGESKKFLRERLCEKYGDKLSQNQIKRILGLKFKDWGNLSKEFLELSGVNKKTNESMSIIKALWENNLNMMELINSDLFDFKEKIVEYQTDLMKTIYNIEVDDLENYYFSAPVKRMVWQTILVVKELVGVLGCEPTRIFIEMTRRHDEITKRTINRKKKFEALYKSVKDEDTDWMNVIADADDTGRIRSKKMYLYLTQKGRCMYTGKHIELSDLFNNNLYDIDHIYPRHFVKDDNIDNNLVLVCKEKNAHKRDIYPLEEQIYSSQKGMWLELKKLGFINEEKYNRLTGRNSFTDEQKAGFIARQLVETSQGTKGVANILQQLLPESKIVYAKASNVSEFRQSRDIPKSRLVNEFHHAHDAYLNIVVGNVYYVKFTQDPLKFIKNDYDKDKINNNYNLSKMFDWDVKRKGEVAWIAQKKNGDVGTIATVKKVLSKNTPLMTRYCFEGRGKISKEERHSAKEAKQVGYLPYKTSDLKIKDVTKYGGFTSITVAYYFVVEHDEKKKRIRTIESVPLYLAAKINSNHEELDKYCKNELGLVNFNIRVRKIRIGSLLKQNGYFFYITGKTGNRLIVRNAVNICFRKEWIKYSSKIEKYQEKKIIDDIITKDKNELFYDEFIKKYENSIFANRPNSILEKLKKAFPVFKESNIEQQCSILYQLLNLSKILGSECDLRLIGESPNCGKMLINKKIGDDDIYLINQSVTGLYENKINLRTV

SEQ ID NO: 3060 - protein, 1352 aa, Unknown
  Description of Unknown: uncultivated organism sequence
  Category: MG91 effectors
  Description: MG91-252 effector
MTAFKYYLGLDMGTNSVGWAATDPGYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCSKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3061 - protein, 1358 aa, Unknown
  Description of Unknown: uncultivated organism sequence
  Category: MG91 effectors
  Description: MG91-253 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHVSELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSLRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3062 - protein, 1358 aa, Unknown
  Description of Unknown: uncultivated organism sequence
  Category: MG91 effectors
  Description: MG91-254 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITYANECILINQSVTGLYENRIDLLRV

SEQ ID NO: 3063 - protein, 1352 aa, Unknown
  Description of Unknown: uncultivated organism sequence
  Category: MG91 effectors
  Description: MG91-255 effector
MTAFKYYLGLDMGTNSVGWAATDPEYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3064 - protein, 1358 aa, Unknown
  Description of Unknown: uncultivated organism sequence
  Category: MG91 effectors
  Description: MG91-256 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSEEKSRRNYKERKHEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYVQLCLNGKWVDYIHKLEKYQDKGFIDNVITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3065 - protein, 1358 aa, Unknown
  Description of Unknown: uncultivated organism sequence
  Category: MG91 effectors
  Description: MG91-257 effector
MRETGKDYYLGLDMGTNSVGWAVTDENYVLMRAKGKDLWGIREFDEALTAVDRRTHRVARRRRQREIARIGLLKEYFHDAIAEVDPDFYQRLDNSKYHEEDKDSAVKGKNGIFNDANYNDKDYFKQYPTIFHLRKELIESTEKHDVRLVYLALLNMFKHRGHFLNAGLSTESENTMDTAYHNFVETAAQTIECNFMETVDIEKIKEILGSRDYSRSKKAELVAQILHVDSKNKVQMACIKCICGLKVTAAAIFGDKMAADEEKKTDICFSDFGYDEKVPVILEIVGEENFELVLAMQEIYDIGSLAGIMKDSLYLSMARVKEYEQHGKDLRILKGVVKKYGTKEEYDTLFRTMEEGTYSAYVNSVNTKKKSRRDVKKRTRDEFYGRLKKIISKMPQNDSDVLYIKDKMEKEAFLPKQLTASNGVIPNQIHAREMKKILQNAEIYLPFLKEKDTSGLTVSERILKLFSFQIPYYVGPVSEKSKLNGGNGWVVRKEEGTVLPWNIEEKIDMTATSREFVERMVRRCSYLSDERVLPKGSLLYERFCVLNEINAIKVDGVKIPVEIKQDLYSKYFKKGKKVTKKKIAEFLIARGVIKEDQTELISGIDIAVNSTLSTYAKFYAIFGEKMEQDSYKKMVEQIVEWCTIYGDAKKFLEQKIKECYGNVLTQEEIKRITGFKFRDWGRLSKEFLELSGCSKATGEVMPLISMMWETNDNLMELLDDNYYTYREALEEKQNNAFKLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQMGRCMYTGHPIDLEDLFKDNRYDIDHIYPRHFVKDDNIMNNLVLVEKEKNAHKSDNYPLEEEIYKKQLPMWKDLHQRKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTILTVKKMMAKNTPMLTRLSFEGKGGLADQTLYSAEKAKGNGYIPLKTSDSKMQDVTKYGGFNSVSTAYFFLVEHELKGKKVRTLETVPIIWRDRIEKDETMLLKYCTDVLELKNPSIRVKKIKLQSYIKKDGYYMYITGKTLNRIIIKNAVQMCLQQKWIVYIKNIEKAIQKKTIDATITYDANLELYNLIERKYKYEIFKNRPNPMGDKIEQGKKLFEEKSLLEQSKILYELLQLSAIGNVKADLQLIGGSASSGVMLIPKNITDSKEFILINQSVTGLFEQKVDLLTV

SEQ ID NO: 3066 - protein, 1358 aa, Unknown
  Description of Unknown: uncultivated organism sequence
  Category: MG91 effectors
  Description: MG91-258 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHVSELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3067 - protein, 1358 aa, Unknown
  Description of Unknown: uncultivated organism sequence
  Category: MG91 effectors
  Description: MG91-259 effector
MEKEYYLGLDMGTNSVGWAVTDDAYNLIRFKGKDMWGIREFDEANPAVERRTHRTLRRREQRNAVRMGLIRSYFADEIQKVDSNFYQRLDNSFFHVEDKRDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSGEKSRRNYKERKQEDLYNSIKKLLKSVDNVDDTDIEYIKNEMDKENFLPKQLTFKNGVIPNQIHASELKAILKNAEKYLLFLNEKDESGYTVSERILMLFSFQIPYYVGPVSSNSNGWVMRLESGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGGCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKMYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKSIKQFEVRNYVQICLNGKWVDYIHKLENYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3068 - protein, 1352 aa, Unknown
  Description of Unknown: uncultivated organism sequence
  Category: MG91 effectors
  Description: MG91-260 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNQLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3069 - protein, 1352 aa, Unknown
  Description of Unknown: uncultivated organism sequence
  Category: MG91 effectors
  Description: MG91-261 effector
MTAFKYYLGLDMGTNSVGWAATDPGYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRSPFSDEKKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDTVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3070 - protein, 1358 aa, Unknown
  Description of Unknown: uncultivated organism sequence
  Category: MG91 effectors
  Description: MG91-262 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHVSELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKKVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQRMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3071 - protein, 1175 aa, Unknown
  Description of Unknown: uncultivated organism sequence
  Category: MG91 effectors
  Description: MG91-263 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAVTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTIYDKLFRSEENGTYSAYVNSFNSEEKSRRNYKERKQEDLYNSIKKLLKSVDNVYDTDIEYIKNEMDKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSISGERIAVALKQDLYNTLFLKGKRVTRKQIFNYFHSRGLVEEDSQISGIDIAVNNSLSTYGKFLPLFGDHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDNLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSVNSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDTYIPLKSSDARMADVTKYGGYSSVTTAYLFLVEHEIKGKKIRTLETVPIYLKDRLENSKEKLEEYCR

SEQ ID NO: 3072 - protein, 1352 aa, Unknown
  Description of Unknown: uncultivated organism sequence
  Category: MG91 effectors
  Description: MG91-264 effector
MTAFKYYLGLDMGTNSVGWAATDPEYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYTKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3073 - protein, 1352 aa, Unknown
  Description of Unknown: uncultivated organism sequence
  Category: MG91 effectors
  Description: MG91-265 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3074 - protein, 1364 aa, Unknown
  Description of Unknown: uncultivated organism sequence
  Category: MG91 effectors
  Description: MG91-266 effector
MEKEYYLGLDMGTSSVGWAVTDKEYRLLRAKGKDMWGIREFEEAQTAVERRTHRLSKRRRARQLVRIGLLKDYFHDEIMKIDPNFYIRLENSKYYLEDKDVRLASSNGIFDDKNYTDKDYYEQYKTIFHLRSELIHNSQKHDVRLVYLALLNMFKHRGHFLFEGDAYVQGNIGDIYKEFIQLLKNEYYEDENVKLTDQIDYFKLKEILSNSEFSRTAKAEKINSLVHIDKKNKLENTYIRLLCGLEIELKILFPEIDEKIKICFAKGYDEKLVEITEILTDNQLQILENLKKIHDIAALDKIRKGKEYLSDARVAEYEKHREDLALLKKIYREYMTKQDYDRMFREGEDGSYSAYVNSYNTSKKQRRNMKHRKIDEFYGTIRKDLKLLLKQGIQDDNIERILEEIDGNNDNKFMPKQLSFANGVIPNSLHKAEMKAILRNAETYLPFLLETDESGLTVSERILQLFSFHIPYYIGPVSVNSEKNNGNGWVVRREDGEVLPWNIEQKIDYGETSKRFIEKMVRRCTYISGEQVLPKNSFIYEKYCVLNEINNIKIDGERITVELKQNIYNDLYLHGKRVTKKQLINYLNNRGMIEDENQVSGIDINLNNYLGSYGKFLPIFEEKLKEDNYIKIAEDIIYLASIYGDSKKMLKSQIKSKYGDILDDKQIKRILGLKFKDWGRISRRFLELEGLDKETGEITTIIKAMWDYNLNFMEIIHSDAFDFKDKIEELHANSIKPLAEIEVEDLDDMYFSAPVKRMIWQTFKVIKEIEKVMGCPPKKVFIEMTRINDKKSKGKRTNSRKEKFLSLYKNIHDELVDWKQLIISSDESGKLNSKKMYLYLTQQGICMYTGRRINLEELFDDNKYDIDHIYPRHFVKDDNLENNLVLVEKQSNSRKSDTYPIDKSIRNNSQVYKHWKSLREGNFISKEKYDRLTGKNEFTDEQKAGFIARQMVETSQGTKGVADIIKQALPQSRIIYSKASNVSEFRRKYDILKSRTVNEFHHAHDAYLNIVVGNVYDTKFTSNPLNFIKKQYNVDRKANNYNLDKMFVYDVKRGNEIAWIGWNPKKSEDSSEMSKRGTIVTVKKMLSKNTPLMTRMSFVGHGGIAEDNLSSHFVAKNKGYMPNGKESDVTKYGGYKKAKTAYFFVVEHGQTNNRIRTIETLPIYRRREVEKYEDGLIKYCEQSLSLLNPIIIYKKIKIQSLMKINGYYAYISGKSNEVYTFRNGVNMCLSQEWINYVKKLENYIEKDRQDRMITYEKNIELYEIILRKYSTTILNKRLSKMDKKLINAKDRFCILNVKEQSQVLINVFVLSRIGDNQTDLSKIGIGKQSGQITQNKKITGCKEFKLVNQSVTGLYENEIDLLTV

SEQ ID NO: 3075 - protein, 1352 aa, Unknown
  Description of Unknown: uncultivated organism sequence
  Category: MG91 effectors
  Description: MG91-267 effector
MTAFKYYLGLDMGTNSVGWAATDPEYRLLKAKGKDLWGIREFNEASGAVERRTHRISRRRKQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRSPFSDEKKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3076 - protein, 524 aa, Unknown
  Description of Unknown: uncultivated organism sequence
  Category: MG91 effectors
  Description: MG91-268 effector
MNEVFVLELPLQVEKYQADILNRRYEQLRQLYNYVQGKLLRQYRYFEQMKEYQACKTFKEKKDFLKNHPFQIKGVYGSNKELLDITFDEYGIQGFIEKLMHKPVGADMTYADLGINTYVLDRLSSSVWAAWEKKIYDYRAKRVSFKKYGELDSFSSRRKVSSGKIYFSGMELHLDTMELAVKTNGKVGKAAKFITLPILHNPKHADYEMWALKGGIDSVKVITVVRRLVRGQYKYYVQLSIEGEKPLKGRTLGKGNVGIDLGPTTVAISGNNNVSIDKLAPKCDNIQKEITKLSRKIDRSRRANNPQNFNEDGTIKRGIRLVWNDSKRYKALRRELAELQRRQAAIRKQQHIDRANELLKEGDTFIVENNSISGWATKAKETKVSEKTGKIQKKKRFGKSIANHAPAMFVNILENKVKSLGGQVVKVDTKNAASQYDFTDNSFEKHELNERNVTLSNGDTHQRDMLAAFNLQHLKYDAEESKQYDVEAMKEDYDRFCQLEKAEVMRYKNKEKKDDRSTIGAGKL

SEQ ID NO: 3077 - protein, 1352 aa, Unknown
  Description of Unknown: uncultivated organism sequence
  Category: MG91 effectors
  Description: MG91-269 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNYGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEINIAKKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLYTRGIIETEEQVTGVDVSINSALTTYGKFKPIFGEDISKDSVQKMIEDIVFWCTVYGDSRKFLKARIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDNYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVAGAYFFLVEHTEKKKRIRTIESVPVYLTRKIEQKPGELKKYCDEILGLVDADIRLKKIKIGSLIKRNGYFCYITGKTGNQLSVRNAVNLCLKNEWIKYISKLEKVKEKDTIDKIITKEKNEVLYSELIQKFKHCIFSKRPNPVGDKLEKGSEKFSNLSIKEQCAVLCQILQLAAVLGSECDMTLLGESAHCGKMLISKKIGDEEIYLINQSVTGLYEKKINLHTV

SEQ ID NO: 3078 - protein, 1358 aa, Unknown
  Description of Unknown: uncultivated organism sequence
  Category: MG91 effectors
  Description: MG91-270 effector
MEKEYYLGLDMGTNSVGWAVTDDAYNLIRFKGKDMWGIREFDEANSAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3079 - protein, 1358 aa, Unknown
  Description of Unknown: uncultivated organism sequence
  Category: MG91 effectors
  Description: MG91-271 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIHKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3080 - protein, 1358 aa, Unknown
  Description of Unknown: uncultivated organism sequence
  Category: MG91 effectors
  Description: MG91-272 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDDSQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSGEKSRRNYKERKQEDLYNSIKKLLKSVDNVYDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQVKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITYANECILINQSVTGLYENRIDLLRV

SEQ ID NO: 3081 - protein, 1358 aa, Unknown
  Description of Unknown: uncultivated organism sequence
  Category: MG91 effectors
  Description: MG91-273 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPGTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3082 - protein, 1352 aa, Unknown
  Description of Unknown: uncultivated organism sequence
  Category: MG91 effectors
  Description: MG91-274 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEKKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3083 - protein, 1342 aa, Unknown
  Description of Unknown: uncultivated organism sequence
  Category: MG91 effectors
  Description: MG91-275 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQHQFDFLFRGTEKGSYSAYVHSVNSHEKQRRNMDGNKKEDLYSTLKKILKDMPENEEKTYIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTDAQIKRILGIKFRDWGNLSKKFLELQGCSKETGEVNSLIRMLWETNDNLMELLAQDSYTFKEELENMQESTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLEVLKLSNPDIRVRKILIQSLIKRNGYYMQITGKTGNQLYVRNTVSLCLKQEWVNYIKKLEKGNDENITKDKNLVLYDILVDKHNNTIYSQRPNPVGEKLVKRREEFINLNLNDQVTVLLEILKLTQIALGGANLELINESKTTGSMKISKTVSEEREVTLINQSVTGLYEQRVNLLTV

SEQ ID NO: 3084 - protein, 1342 aa, Unknown
  Description of Unknown: uncultivated organism sequence
  Category: MG91 effectors
  Description: MG91-276 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLVYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTGAQIKRILGIKFRDWGNLSKKFLELQGCSKETGEVNSLIRMLWETNDNLMELLAQDSYTFKEELENMQESTYKVLTELQPEDLDHMYFSAPVKRMVWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASRAKEGTYIPLKSSDERMQDVTKYGGFTSVSTAYFMLVEHDGKKGKRIRTIESVPIMWKERIEKNPAELERYCLDVLKLSNPDIRVRKILIQSLIKRNGYYMQITGKTGNRMYVRNMVSLCLVQDWVNYIKKLEKDKDENISKEKNIRLYDVLMDKHINTIYNTRPNPVGDLLIKRRSDFIELKITDQVIILLEILKLTQTALGSANLKLIGEAEKTGVMLISKDITALDEMLLINQSVTGLYEQRVNLLTV

SEQ ID NO: 3085 - protein, 1342 aa, Unknown
  Description of Unknown: uncultivated organism sequence
  Category: MG91 effectors
  Description: MG91-277 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRGSNGIFNDVEYTDKEYFKEFPTIFHLRQELIKSKEPHDVRLVYLALLNMFKHRGHFLNATLSADGESRKIKDIYTDFVDKVAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQHQFDFLFRGTEKGSYSAYVHSVNSHEKQRRNMDGNKKEDLYSTLKKILKDMPENEEKTYIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTGAQIKRILGIKFRDWGNLSKKFLELQGCSKETGEVNSLIRMLWETNDNLMELLAQDSYTFKEELENMQESAYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLDVLKLSNPDIRVRKILIQSLIKRNGYYMQITGKTGNQLYVRNTVSLCLKQEWVNYIKKLEKGNDENITKDKNLVLYDILVDKHNNTIYSQRPNPVGEKLVKRREEFINLNLNDQVTVLLEILKLTQIALGGANLKLIGEAEKTGVMLISKDITTLDEMLLINQSVTGLYEQKVNLLTV

SEQ ID NO: 3086 - protein, 1342 aa, Unknown
  Description of Unknown: uncultivated organism sequence
  Category: MG91 effectors
  Description: MG91-278 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTGAQIKRILGIKFRDWGNLSKKFLELQGCSKETGEVNSLIRMLWETNDNLMELLAQDSYTFKEELENMQASTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLDVLKLSNPDIRVRKILIQSLIKRNGYYMQITGKTGNRMYVRNMVSLCLVQDWVNYIKKLEKDKDENISKEKNIRLYDVLMDKHINTIYNTRPNPVGDLLIKRRSDFIELKITDQVIILLEILKLTQTALGSANLKLIGEAEKTGVMLISKDITALDEMLLINQSVTGLYEQRVNLLTV

SEQ ID NO: 3087 - protein, 1342 aa, Unknown
  Description of Unknown: uncultivated organism sequence
  Category: MG91 effectors
  Description: MG91-279 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDNTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTGAQIKRILGIKFRDWGNLSKKFLELQGCSKETGEVNSLIRMLWETNDNLMELLAQDSYTFKEELENMQESTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLDVLKLSNPDIRVRKILIQSLIKRNGYYMQITGKTGNQLYVRNTVSLCLKQEWVNYIKKLEKGNDENITKDKNLVLYDILVDKHNNTIYSQRPNPVGEKLVKRREEFINLNLNDQVTVLLEILKLTQIALGGANLKLIGEAEKTGVMLISKDITTLDEMLLINQSVTGLYEQKVNLLTV

SEQ ID NO: 3088 - protein, 1342 aa, Unknown
  Description of Unknown: uncultivated organism sequence
  Category: MG91 effectors
  Description: MG91-280 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTGAQIKRILGIKFRDWGNLSKKFLELQGCSKETGEVNSLIRMLWETNDNLMELLAQDSYTFKEELENMQESTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLDVLKLSNPDIRVRKILIQSLIKRNGYYMQITGKTGNQLYVRNTVSLCLKQEWVNYIKKLEKGNDENITKDKNLVLYDILVDKHNNTIYSQRPNPVGEKLVKRREEFINLNLNDQVTVLLEILKLTQIALGGANLKLIGEAEKTGVMLISKDITTLDEMLLINQSVTGLYEQKVNLLTV

SEQ ID NO: 3089 - protein, 1342 aa, Unknown
  Description of Unknown: uncultivated organism sequence
  Category: MG91 effectors
  Description: MG91-281 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALVNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTISERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTDAQIKRILGIKFRDWGNLSKKFLELQGCSKETGEVNSLIRMLWETNDNLMELLAQDSYTFKEELENMQESTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLEVLKLSNPDIRVRKILIQSLIKRNGYYMQITGKTGNQLYVRNTVSLCLKQEWVNYIKKLEKGNDENITKDKNLVLYDILVDKHNNTIYSQRPNPVGEKLVKRREEFINLNLNDQVTVLLEILKLTQIALGGANLKLIGEAEKTGVMLISKDITTLDEMLLINQSVTGLYEQKVNLLTV

SEQ ID NO: 3090 - protein, 1342 aa, Unknown
  Description of Unknown: uncultivated organism sequence
  Category: MG91 effectors
  Description: MG91-282 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLAYLKHYIKEYGTQQQFDFLFRGTEKGSYSAYVHSVNSHEKQRRNMAGNKKEDLYSALKKMLKDMPENEEKTYIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRITKKSLMQYLVGRGVIKAEDEEQLTGLMDGLNNTLKSFAKFKAIFGDAIYEDSCKKMVEQIIFWCTVYGDSKHFLKEQLLEKYGEVLTDAQIKRILGIKFRDWGNLSKKFLGLQGCSKETGEVNSLIRMLWETNDNLMELLAQDSYTFKEELENMQESTYKVLIELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLEVLKLSNPDIRVRKILIQSLIKRNGYYMQITGKTGNRVYVRNMVSLCLVQDWVNYIKKLEKDKDENISKEKNIRLYDVLMDKHINTIYNTRPNPVGDLLIKRRSDFIELKITDQVIILLEILKLTQTALGSANLKLIGEAEKTGVMLISKDITALEEMLLINQSVTGLYEQRVNLLTV

SEQ ID NO: 3091 - protein, 1358 aa, Unknown
  Description of Unknown: uncultivated organism sequence
  Category: MG91 effectors
  Description: MG91-283 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITYANECILINQSVTGLYENRIDLLGV

SEQ ID NO: 3092 - protein, 1358 aa, Unknown
  Description of Unknown: uncultivated organism sequence
  Category: MG91 effectors
  Description: MG91-284 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDDSQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSGEKSRRNYKERKQEDLYNSIKKLLKSVDNVYDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQVKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITDANECILINQSVTGLYENRIDLLRV

SEQ ID NO: 3093 - protein, 1352 aa, Unknown
  Description of Unknown: uncultivated organism sequence
  Category: MG91 effectors
  Description: MG91-285 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLYTRGIIETEEQVTGVDVSINSALTTYGKFKPIFGEDISKDSVQKMIEDIVFWCTVYGDSRKFLKARIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDNYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVAGAYFFLVEHTEKKKRIRTIESVPVYLTRKIEQKPGELKKYCDEILGLVDADIRLKKIKIGSLIKRNGYFCYITGKTGNQLSVRNAVNLCLKNEWIKYISKLEKVKEKDTIDKIITKEKNEVLYSELIQKFKHCIFSKRPNPVGDKLEKGSEKFSNLSIKEQCAVLCQILQLAAVLGSECDMTLLGESAHCGKMLISKKIGDEEIYLINQSVTGLYEKKINLHTV

SEQ ID NO: 3094 - protein, 1358 aa, Unknown
  Description of Unknown: uncultivated organism sequence
  Category: MG91 effectors
  Description: MG91-286 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSIDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDITVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3095 - protein, 1358 aa, Unknown
  Description of Unknown: uncultivated organism sequence
  Category: MG91 effectors
  Description: MG91-287 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITDANECILINQSVTGLYENRIDLLRV

SEQ ID NO: 3096 - protein, 1358 aa, Unknown
  Description of Unknown: uncultivated organism sequence
  Category: MG91 effectors
  Description: MG91-288 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFYVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKDSLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDILENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3097 - protein, 1358 aa, Unknown
  Description of Unknown: uncultivated organism sequence
  Category: MG91 effectors
  Description: MG91-289 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDELGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITYANECILINQSVTGLYENRIDLLRV

SEQ ID NO: 3098 - protein, 1358 aa, Unknown
  Description of Unknown: uncultivated organism sequence
  Category: MG91 effectors
  Description: MG91-290 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQIEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3099 - protein, 1352 aa, Unknown
  Description of Unknown: uncultivated organism sequence
  Category: MG91 effectors
  Description: MG91-291 effector
MTAFKYYLGLDMGTNSVGWAATDPEYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMMKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3100 - protein, 1358 aa, Unknown
  Description of Unknown: uncultivated organism sequence
  Category: MG91 effectors
  Description: MG91-292 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGEIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSITTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3101 - protein, 1352 aa, Unknown
  Description of Unknown: uncultivated organism sequence
  Category: MG91 effectors
  Description: MG91-293 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKKKERRVGNKRTSEELYKEIKKLLKDAQKEDENVQKILTSIENETFLPKQLTASNGVIQNQVHAREMKKILSNAENYLPFLTKKDETGLSVSERILKLFTFQIPYYIGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGKQLIVRNAVNLCLKNEWIKYISKLEKVKEIDAVDKIITKEKNEVLYSELIQKFKHGIFSKRPNPVGDKLEKGSEKFSNLSIKEQCAVLCQILQLAAVLGSECDMTLLGESAHCGKMLISKKIGDEEIYLINQSVTGLYEKKINLHTV

SEQ ID NO: 3102 - protein, 1352 aa, Unknown
  Description of Unknown: uncultivated organism sequence
  Category: MG91 effectors
  Description: MG91-294 effector
MTAFKYYLGLDMGTNSVGWAATDPEYRLLKAKGKDLWGIREFNEASGAVERRTHRISRRRRQREQVRIGILKDYFHDAICEVDPGFFRRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSHDIDCKQIEAILSRRDMSRTHKVEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTENDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3103 - protein, 1353 aa, Unknown
  Description of Unknown: uncultivated organism sequence
  Category: MG91 effectors
  Description: MG91-295 effector
MAAYYLGLDMGTSSVGWAVTNEQYELIKKKGKDLWGIREFDEAHTAVDRRMMRVSRRRRQRELARIGLLKEYFQDAIAEVDPNFYARLENSKYHLEDKDVSVRTYNGIFADKDYTDKEYFAEYPTIFHLRKELLESQEPHDVRLVYLALVNMFKHRGHFLNATLSSDSENRSIKDVWNEFAEQVYELLGISFSDEIDYMALQEIMCSTDISRKKKAEELVQLLKIDKKEKQKIALLECVIGLNVSIKTIFGACISDDFDPKMKISFSDAGYEEKIVDIQEVLGDENFELIAGMKALYDAAILNQIMGGNAYLSIARVQEYEKHKSDLKILKSIYRKYATKKDYDDMFRSTEKGSYSAYTNSTNSDKVANAENGGEPVRRGIEGRKKEDLYANIKKKLAEMPEDEDVQYVLNEIEKDHFLPKQLTASNGVIPNQIHLKEMKKILSNAENYLPFLKEKDESGYTTTERILKLFSFQIPYYVGPVTEKSARDGGNGWVIRKEDGVVLPWNINEKIDMKKTSEAFISRMVRRCTYMSGEQVLPKASLEYESFCVLNELNNLKVRGEKLPVEIKQNMYKDLFETGKRVTKNKIIKYLIGQGVLSEGNEDELTGLMDGINGTLSSFAKFRAVFGDAIYEDSCKKMVEQIIFWCTVYGDSKSFLKEQLEEKYAKDLTPEQMKRILGFKFKDWGNLSKEFLELNGCKKDTGEAASLIRMLWETNDNLMELLAKDKYTYQEKLQESQEKSYKILSEMQPEDLEDYYFSAPVKRMVWQTLLVIKEIEKVMGEPPKRLFVEMTRSENKKEGMKNSRAKKFLDLYKKIKDEDKDWKKIIESADEDGRIRSKKMYLYLTQKGRCMYTGRPIDLDQLFNNNLYDIDHIYPRHFVKDDNLENNLVLVEKEKNARKSDTYPLDEEIYKKQLNWWRELHQQNLINDEKFKRLTGRNPFSDEQKAGFIARQLVETSQGTKGVATILKEVFPEETTIVYAKARNVSDFRHDYDLLKSRIVNDFHHAQDAYLNIVVGNVYYVKFTQNPMNFIRENKSYNLGKMFAWDVKRGNETAWIAKPENGSAATIATVRKVMAKNTPLLTRLSFEGGGGIANQTLYSAKKAKEEGYIPLKSSDPKMQDIKKYGGYTSVTTAYFILVEHGTEKKRIRTIESVTLIWKDRIEKNPDELQVYCEEVLGLINPDIRVRKILIQSLIKREGYYMHISGKTGNQIKLRNAVSLCLKTTWTNYIKKLEKGEKTEEITKASNIALYEELMRKHKETIYAKRPNPVGDKLLSGEEKFEKMEVEIQIKVLLEILKLTQIGLPTADLREIGESANTGVMLMSKNITKLQEIKLIHQSVTGIYEQQVDLLTV

SEQ ID NO: 3104 - protein, 1352 aa, Unknown
  Description of Unknown: uncultivated organism sequence
  Category: MG91 effectors
  Description: MG91-296 effector
MTAFKYYLGLDMGTNSVGWAATDPEYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQFCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3105 - protein, 1274 aa, Unknown
  Description of Unknown: uncultivated organism sequence
  Category: MG91 effectors
  Description: MG91-297 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKMWNCIMFYAKNIVWAYLHYVRIR

SEQ ID NO: 3106 - protein, 1352 aa, Unknown
  Description of Unknown: uncultivated organism sequence
  Category: MG91 effectors
  Description: MG91-298 effector
MTAFKYYLGLDMGTNSVGWAATDPEYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKIKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3107 - protein, 1352 aa, Unknown
  Description of Unknown: uncultivated organism sequence
  Category: MG91 effectors
  Description: MG91-299 effector
MTAFKYYLGLDMGTNSVGWAATDPEYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAFLSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3108 - protein, 1352 aa, Unknown
  Description of Unknown: uncultivated organism sequence
  Category: MG91 effectors
  Description: MG91-300 effector
MTAFKYYLGLDMGTNSVGWAATDPGYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILELIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3109 - protein, 1342 aa, Unknown
  Description of Unknown: uncultivated organism sequence
  Category: MG91 effectors
  Description: MG91-301 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRGSNGIFNDAEYTDKEYFKEFPTIFHLRQELIKSKEPHDVRLVYLALLNMFKHRGHFLNATLSADGESRKIKDIYTDFVDKAAEQLGISFATDIKYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQHQFDFLFRGTEKGSYSAYVHSVNSHEKQRRNMDGNKKEDLYSTLKKILKDMPENEEKTHIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEEFISRMVRRCTYMNDEQVLPKESLEYESFCVLNELNNIKVYGEKLPVDIKQDIYRTLCEKGKRITKKSLMKYLVGRGVIKAEDEEQLTGLMDGLNNTLKSFAKFKAIFGDAIYEDSCKKMVEQIIFWCTVYGDSKHFLKEQLLEKYGEVLTDAQIKRILGIKFRDWGNLSKKFLELQGCCKETGEVNSLIRMLWETNDNLMELLARDSYTFKEELENMQESTYKVLAELQPEDLDHMYFSAPVKRMIWQTILIIKEVTKVIGCQPERLFIEMTREHGQKNDIKDSRAKKFYELYSKIKDEDKDWRKVIEDADKDGRIRSKKMYLYLTQMGRCMYTGRPIELDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKAKNVSDFRNDYDLLKSRIVNDFHHAHDAYLNIVIGNVYYVKFTKNPINFIREHGTYNLGKMYAKDVKRGDEIAWVAQSGNGQTATMETIRRTMARNTPLLTRMSYEVTGGLANQTLYSASKAKEGTYISLKSSDERMQDVTKYGGFTSVSTAYFMLVEHDGKKGKRIRTIESVPIMWKERIEKNPVELERYCLEVLKLSNPDIRVRKILIQSLIKRNGYFMYITGKTNKQLSVRNKVSLCLTQNWVNYIKNLENDNDDNITKKENLELYDILSDKHNNTIYRQRPNPVGSKLHKCRDRFINLEMNEQKVVLLEILKLTQIASTSANLELLGESKQTGVMFIGKDITALDEILLINQSVTGLYEQRVNLLTV

SEQ ID NO: 3110 - protein, 1353 aa, Unknown
  Description of Unknown: uncultivated organism sequence
  Category: MG91 effectors
  Description: MG91-302 effector
MAAYYLGLDMGTSSVGWAVTNEQYELIKKKGKDLWGIREFDEAHTAVDRRMMRVSRRRRQRELARIGFLKEYFQDAIAEVDPNFYARLENSKYHLEDKDVSVRTYNGIFADKDYTDKEYFAEYPTIFHLRKELLESQEPHDVRLVYLALVNMFKHRGHFLNATLSSDSENRSIKDVWNEFAEQVYELLGISFSDEIDYMALQEIMCSTDISRKKKAEELVQLLKIDKKEKQKIALLECVIGLNVSIKTIFGACISDDFDPKMKISFSDAGYEEKIVDIQEVLGDENFELIAGMKALYDAAILNQIMGGNAYLSIARVQEYEKHKSDLKILKSIYRKYATKKDYDDMFRSTEKGSYSAYTNSTNSDKVANAENGGEPVRRGIEGRKKEDLYANIKKKLAEMPEDEDVQYVLNEIEKDHFLPKQLTASNGVIPNQIHLKEMKKILSNAENYLPFLKEKDESGYTTTERILKLFSFQIPYYVGPVTEKSARDGGNGWVVRKEDGVVLPWNINEKIDMKKTSEAFISRMVRRCTYMSGEQVLPKASLEYESFCVLNELNNLKVRGEKLPIEIKQNMYKDLFETGKRVTKNKIVKYLIGQGVLCEGNEDELTGLMDGINGTLSSFAKFRAVFGDAIYEDSCKKMVEQIIFWCTVYGDSKSFLKEQLEEKYAKDLTPEQMKRILGFKFKDWGNLSKEFLELNGCKKDTGEAASLIRMMWETNDNLMELLAKDKYTYQEKLQESQEKSYKILSEMQLEDLEDYYFSAPVKRMVWQTLLVIKEIEKVMGEPPKRLFVEMTRSEDKKKEMKDSRAKKFLELYKKIKDEDKDWKKIIESADEDGRIRSKKMYLYLTQKGRCMYTGRPIDLDQLFNNNLYDIDHIYPRHFVKDDNLENNLVLVEKEKNARKSDTYPLDEEIYKKQLNWWRELHQQNLINDEKFKRLTGRNPFSDEQKAGFIARQLVETSQGTKGVATILKEVFSEETTIVYAKARNVSDFRHDYDLLKSRIVNDFHHAQDAYLNIVVGNVYYVKFTQNPMNFIRENKSYNLGKMFAWDVKRGNETAWIAKPENGSAATIATVRKVMAKNTPLLTRLSFEGSGGIANQTLYSAKKAKEEGYIPLKSSDPKMQDIKKYGGYTSVTTAYFILVEHGTEKKRIRTIESVTLIWKDRIEKNPDELQVYCEEVLGLINPDIRVRKILIQSLIKREGYYMHISGKTGNQIKLRNAVSLCLKTTWTNYIKKLEKGEKTEEITKASNIALYEELMRKHKETIYAKRPNPVGDKLLSGEEKFEKMEVEIQIKVLLEILKLTQIGLPTADLREIGESANTGVMLMSKNITKLQEIKLIHQSVTGIYEQQVDLLTV

SEQ ID NO: 3111 - protein, 1352 aa, Unknown
  Description of Unknown: uncultivated organism sequence
  Category: MG91 effectors
  Description: MG91-303 effector
MQEKPYYLGLDMGTNSVGWAVTDQHYNLLKAKGKDLLGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIDDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLTSNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3112 - protein, 1342 aa, Unknown
  Description of Unknown: uncultivated organism sequence
  Category: MG91 effectors
  Description: MG91-304 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPENFDKTIKVNFSDIAFEEKATEISEAIGEEKYDLILIMKEIYDAAILNRIMNGYTYLSDARVAEYEKHKSDLAYLKHYIKEYGTQQQFDFLFRGTEKGSYSAYVHSVNSHEKQRRNMAGNKKEDLYSALKKMLKDMPENEEKTYIMMQIELDNFLPKQLTASNGVIPNQIHLKEMKKILANAENYLSFLKEKDESGYTVSERIQKLFAFQIPYYIGPTTEKSAEFGGNGWVVRKEEGKVLPWNIDQKIDMKKTSEKFISRMVRRCTYVNDEQVLPKESLEYESFCVLNELNNIKVYGEKLPVDIKQDIYRTLCEKGKRITKKSLMKYLVGRGVIKAEDEEQLTGLMDGLNNTLKSFAKFKTIFGDAIYEDSCKKMVEQIIFWCTVYGDSKHFLKEQLLEKYGEVLTDAQIKRILGIKFRDWGNLSKKFLELQGCCKETGEVNSLIRMLWETNDNLMELLARDSYTFKEELEKMQESTYKVLTELQPEDLDHMYFSAPVKRMIWQTILIIKEVTKVIGCQPERLFIEMTREHGQKNDIKDSRAKKFYELYSKIKDEDKDWRKVIEDADKDGRIRSKKMYLYLTQMGRCMYTGRPIELDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKAKNVSDFRNDYDLLKSRIVNDFHHAHDAYLNIVIGNVYYVKFTKNPINFIREHGTYNLGKMYAKDVKRGDEIAWVAQSGNGQTATMETIRRTMARNTPLLTRMSYEVTGGLANQTLYSANTAKEGIYIPLKSSDEKMHDITKYGGFTSVKGAYFILVEHDDKKGKRIRTIESVPIMWKGRIEKNPAELERYCVEVLKLHNPEIKIRKILYKSLIRENGYYMYISSNEEGRLCMMNAVSLCLKQDWINYIHKLEKLNFENISREKNIKLYQILCDKHKNTIYINRPNSLGKLFDECKENFFDLTLNDQVTVLLEMLKTTQISLATANFSILNKGKNIGKMRMNKKISNEKDILLINQSVTGLYEQKVNLLTV

SEQ ID NO: 3113 - protein, 1245 aa, Unknown
  Description of Unknown: uncultivated organism sequence
  Category: MG91 effectors
  Description: MG91-305 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLYTRGIIETEEQVTGVDVSINSALTTYGKFKPIFGEDISKDSVQKMIEDIVFWCTVYGDSRKFLKARIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDNYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVAGAYFFLVEHTEKKKRIRTIESVPVYLTRKIEQKPGELKKYCDEILGLVDADIRLKKIKIGSLIKRNGYFCYITGKTGNQLSVRNAVNLCLKNEWIKYISKLEKVKEKDTIDKIITKE

SEQ ID NO: 3114 - protein, 1352 aa, Unknown
  Description of Unknown: uncultivated organism sequence
  Category: MG91 effectors
  Description: MG91-306 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3115 - protein, 1342 aa, Unknown
  Description of Unknown: uncultivated organism sequence
  Category: MG91 effectors
  Description: MG91-307 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQHQFDFLFRGTEKGSYSAYVHSVNSHEKQRRNMDGNKKEDLYSTLKKMLKDMPENEEKTYIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRITKKSLMQYLVGRGVIKAEDEEQLTGLMDGLNNTLKSFAKFKAIFGDAIYEDSCKKMVEQIIFWCTVYGDSKHFLKEQLLEKYGEVLTDAQIKRILGIKFRDWGNLSKKFLELQGCSKETGEVNSLIRMLWETNDNLMELLAQDSYTFKEELENMQESTYKVLAELQPEDLDHMYFSAPVKRMIWQTILIIKEVTKVIGCQPERLFIEMTREHGQKNDIKDSRAKKFYELYSKIKDEDKDWRKVIEDADKDGRIRSKKMYLYLTQMGRCMYTGRPIELDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLEVLKLSNPDIRVRKILIQSLIKRNGYYMQITGKTGNRMYVRNMVSLCLVQDWVNYIKKLEKDKDENISKEKNIRLYDVLMDKHINTIYNTRPNPVGDLLIKRRSDFIELKITDQVIILLEILKLTQTALGSANLKLIGEAEKTGVMLISKDITALDEMLLINQSVTGLYEQRVNLLTV

SEQ ID NO: 3116 - protein, 1358 aa, Unknown
  Description of Unknown: uncultivated organism sequence
  Category: MG91 effectors
  Description: MG91-308 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFYVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3117 - protein, 1358 aa, Unknown
  Description of Unknown: uncultivated organism sequence
  Category: MG91 effectors
  Description: MG91-309 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3118 - protein, 1352 aa, Unknown
  Description of Unknown: uncultivated organism sequence
  Category: MG91 effectors
  Description: MG91-310 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKFNRLMGRNAFTDEQKAGFIARQLVETSQGTKGVAELFHQLLPNSKIVYAKAGNVSDFRRNREFPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3119 - protein, 1342 aa, Unknown
  Description of Unknown: uncultivated organism sequence
  Category: MG91 effectors
  Description: MG91-311 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRGSNGIFNDAEYTDKEYFKEFPTIFHLRQELIKSKEPHDVRLVYLALLNMFKHRGHFLNATLSADGESRKIKDIYTDFVDKAAEQLGISFATDIKYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQHQFDFLFRGTEKGSYSAYVHSVNSHEKQRRNMDGNKKEDLYSTLKKILKDMPENEEKTHIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEEFISRMVRRCTYMNDEQVLPKESLEYESFCVLNELNNIKVYGEKLPVDIKQDIYRTLCEKGKRITKKSLMKYLVGRGVIKAEDEEQLTGLMDGLNNTLKSFAKFKAIFGDAIYEDSCKKMVEQIIFWCTVYGDSKHFLKEQLLEKYGEVLTDAQIKRILGIKFRDWGNLSKKFLELQGCSKETGEVNSLIRMLWETNDNLMELLAQDSYTFKEELENMQESTYKVLAELQPEDLDHMYFSAPVKRMIWQTILIIKEVTKVIGCQPERLFIEMTREHGQKNDIKDSRAKKFYELYSKIKDEDKDWRKVIEDADKDGRIRSKKMYLYLTQMGRCMYTGRPIELDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSDFRKDNDLLKSRIVNDFHHAHDAYLNIVIGNVYYVKFTKNPINFIREHGTYNLGKMYAKDVKRGDEIAWVAQSGNGQTATMETIRRTMARNTPLLTRMSYEVTGGLANQTLYSANTAKEGTYIPLKSSDERMQDVTKYGGFTSVSTAYFMLVEHDGKKGKRIRTIESVPIMWKERIEKNPVELERYCLEVLKLSNPDIRVRKILIQSLIKRNGYFMYITGKTNKQLSVRNKVSLCLTQNWVNYIKNLENDNDDNITKKENLELYDILSDKHNNTIYRQRPNPVGSKLHKCRDRFINLKMNEQKVVLLEILKLTQIASTSANLELLGESKQTGVMFIGKDITALDEILLINQSVTGLYEQRVNLLTV

SEQ ID NO: 3120 - protein, 1352 aa, Unknown
  Description of Unknown: uncultivated organism sequence
  Category: MG91 effectors
  Description: MG91-312 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKKKERRVGNKRTSEELYKEIKKLLKDAQKEDENVQKILTSIENETFLPKQLTASNGVIPNQVHAREMKKILSNAENYLPFLTKKDETGLSVSERILKLFTFQIPYYIGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGKQLIVRNAVNLCLKNEWIKYISKLEKVKEIDAVDKIITKEKNEVLYSELIQKFKHGIFSKRPNPVGDKLEKGSEKFSNLSIKEQCAVLCQILQLAAVLGSECDMTLLGESAHCGKMLISKKIGDEEIYLINQSVTGLYEKKINLHTV

SEQ ID NO: 3121 - protein, 1351 aa, Unknown
  Description of Unknown: uncultivated organism sequence
  Category: MG91 effectors
  Description: MG91-313 effector
MAAYYLGLDMGTSSVGWAVTNEQYELIKKKGKDLWGIREFDEAHTAVDRRMMRVSRRRRQRELARIGLLKEYFQDAIAEVDPNFYARLENSKYHLEDKDVSVRTYNGIFADKDYTDKEYFAEYPTIFHLRKELLESQEPHDVRLVYLALVNMFKHRGHFLNATLSSDSENRSIKDVWNEFAEQVYELLGISFSDEIDYMALQEIMCSTDISRKKKAEELVQLLKIDKKEKQKIALLECVIGLNVSIKTIFGACISDDFDPKMKISFSDAGYEEKIVDIQEVLGDENFELIAGMKALYDAAILNQIMGGNAYLSIARVQEYEKHKSDLKILKSIYRKYATKKDYDDMFRSTEKGSYSAYTNSTNSDKVANAENGGEPVRRGIEGRKKEDLYANIKKKLAEMPEDVQYVLNEIEKDHFLPKQLTASNGVIPNQIHLKEMKKILSNAENYLLFLKEKDESGYTTTERILKLFSFQIPYYVGPVTEKSARDGGNGWVVRKEDGVVLPWNINEKIDMKKTSEAFISRMVRRCTYMSGEQVLPKASLEYESFCVLNELNNLKVRGEKLPIEIKQNMYKDLFETGKRVTKNKIVKYLIGQGVLCEGNEDELTGLMDGINGTLSSFAKFRAVFGDAIYEDSCKKMVEQIIFWCTVYGDSKSFLKEQLEEKYAKDLTPEQMKRILGFKFKDWGNLSKEFLELNGCKKDTGEAASLIRMMWETNDNLMELLAKDKYTYQEKLQESQEKSYKILSEMQPEDLEDYYFSAPVKRMVWQTLLVIKEIEKVMGEPPKRLFVEMTRSEDKKKEMKDSRTKKFLELYKKIKDEDKDWKKIIESADEDGRIRSKKMYLYLTQKGRCMYTGRPIDLDQLFNNNLYDIDHIYPRHFVKDDNLENNLVLVEKEKNARKSDTYPLDEEIYKKQLNWWRELHQQNLINDEKFKRLTGRNPFSDEQKAGFIARQLVETSQGTKGVATILKEVLPEETTIVYAKARNVSDFRHDYNLLKSRIVNDFHHAQDAYLNIVVGNVYYVKFTQNPMNFIRENKSYNLGKMFAWDVKRGNETAWIAKPENGSAATIATVRKVMAKNTPLLTRLSFEGSGGIANQTLYSAKKTKEEGYIPLKSSDPKMQDIKKYGGYTSVTTAYFILVEHGTEKKRIRTIESVTLIWKDRIEKNPDELQVYCEKVLGLINPDIRVRKILIQSLIKREGYYMHISGKTENRLTLRNAVSLCLKTTWINYIKKLEKGEKTEEITKTSNIALYEELMRKHKETIYAKRPNPVGDKLLYGEDKFEKLELETQIKILLEILKLTQIGLPEADLREIGGAKSTGTIKVGKKISGLHELKLIHQSVTGIYEQQVDLLTV

SEQ ID NO: 3122 - protein, 1352 aa, Unknown
  Description of Unknown: uncultivated organism sequence
  Category: MG91 effectors
  Description: MG91-314 effector
MTAFKYYLGLDMGTNSVGWAATDPGYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVTNILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3123 - protein, 1352 aa, Unknown
  Description of Unknown: uncultivated organism sequence
  Category: MG91 effectors
  Description: MG91-315 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNVYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLPVSERILKLFTFQIPYYVGPTSENSGKNGGNGWVVRREDGQVLPWNIDEKIDMKATSEAFISRMVRRCTYISGEQVLPTASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRNPFSDEQKAGFIARQLVETSQGTKGVANILRQLLPGSKIVYAKASNVSEFRRTRDDIPKSRLVNDFHHAHDAYLNIVVGNVYYVKFTQNPLNFIKKDYDNYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTSVTGAYFFLVEHAEKKKRIRTIESVPVYLAQKIEQNPDELKKYCEEILGLIDADIRLKKIKIGSLIKRNGYFCYITGKTGKQLIVRNAVNLCLKNEWIKYISKLEKVKEKDAVDKIITKEKNEVLYSELIQKFKHGIFSKRPNPVGDKLEKGSEKFSNLSIKEQCTVLCQILQLAAVLGSECDMTLLGESAHCGKMLISKKIGDEEIYLINQSVTGLYEKKINLHTV

SEQ ID NO: 3124 - protein, 1352 aa, Unknown
  Description of Unknown: uncultivated organism sequence
  Category: MG91 effectors
  Description: MG91-316 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGDSPNCGKMLISKKIGDEEIYLLNQSVTGLYEKKINLHTV

SEQ ID NO: 3125 - protein, 1352 aa, Unknown
  Description of Unknown: uncultivated organism sequence
  Category: MG91 effectors
  Description: MG91-317 effector
MTAFKYYLGLDMGTNSVGWAATDPEYRLLKAKGKDLWGIREFNEASGAVERRTHRISRRRRQREQVRIGILKDYFHDAICEVNPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCKEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3126 - protein, 359 aa, Unknown
  Description of Unknown: uncultivated organism sequence
  Category: MG91 effectors
  Description: MG91-318 effector
MYNKGGKNTTVSAKVNTNLSPDEKPKDLRGRFLSNQNYRLMKSVLRFSSEYVQGVRRVNDLVEMKCDDTKCKEITTNAKCQGECGKIFNNGKFLFCVYDTSAAAATASSSGEAKFKLVCNLCSNDYSYNNRYEVLQLFPTVSQQVVERLCEIGFLTKYIFPIKLNYTETQTKTEVINYHDFYKMVKSIIKEKKSNEQITEIKLSTYGRDLFVETDDFCVMRKDSNEFNETVYELDFFPKQSSMLEFLKIYKDNKPLTYFYTVKKRVYLSIFDYAVYFPFKCVLFCKVCTKNKMYLKTHPVLYCSKCGFTDPMFFNNSAFLESTIFLAKCVKYKTMPVARIFYYDMTLYKTFIKKPFVKK

SEQ ID NO: 3127 - protein, 1359 aa, Unknown
  Description of Unknown: uncultivated organism sequence
  Category: MG91 effectors
  Description: MG91-319 effector
MRETGKDYYLGLDMGTNSVGWAVTDENYVLMRAKGKDLWGIREFDEALTAVDRRTHRVARRRRQREIARIGLLKEYFHDAIAEVDPDFYQRLDNSKYHEEDKDSAVKGKNGIFNDANYNDKDYFKQYPTIFHLRKELIESTEKHDVRLVYLALLNMFKHRGHFLNAGLSTESENTMDTAYHNFVETAAQTIECNFMETVDIEKIKEILGSRDYSRSKKAELVAQILHVDSKNKVQMACIKCICGLKVTAAAIFGDKMAADEEKKTDICFSDFGYDEKVPVILEIVGEENFELVLAMQEIYDIGSLAGIMKDSLYLSMARVKEYEQHGKDLRILKGVVKKYGTKEEYDTLFRTMEEGTYSAYVNSVNTKKKSRRDVKKRTRDEFYGRLKKIISKMPQNDSDVLYIKDKMEKEAFLPKQLTASNGVIPNQIHAREMKKILQNAEIYLPFLKEKDTSGLTVSERILKLFSFQIPYYVGPVSEKSKLNGGNGWVVRKEEGAVLPWNIEEKIDMTATSREFVERMVRRCSYLSDERVLPKGSLLYERFCVLNEINAIKVDGVKIPVEIKQDLYSKYFKKGKKVTKKKIAEFLIARGVIKEDQTELISGIDIAVNSTLSTYAKFYAIFGEKMEQDSYKKMVEQIVEWCTIYGDAKKFLEQKIKECYGNILTQEEIKRITGFKFRDWGRLSKEFLELSGCSKATGEVMPLISMMWETNDNLMELLDDNYYTYREALEEKQNNAFKLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQRGRCMYTGHPIDLEDLFKDNRYDIDHIYPRHFVKDDNIMNNLVLVEKEKNAHKSDNYPLEEEIYKKQLPMWKDLHQRKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTILTVKKMMAKNTPMLTRLSFEGKGGLADQTLYSAEKAKGNGYIPLKTSDSKMQDVTKYGGFNSVSTAYFFLVEHELKGKKVRTLETVPIIWRDRIEKDETMLLKYCTDVLELKNPSIRVKKIKLQSYIKKDGYYMYITGKTNKQITTKNAVELCVNQRWIDYIKIIEKTVEKKKEECEEIDYDKNVEFYDLLLTKHTQEIFSNRPNPVGAKLKQGRDKFVSLTLLEQCRVLYEILQLSIIGNTRADLQLIGGAAISGVMLLSKNITDSKEFILINQSVTGLFEQKVDLLTV

SEQ ID NO: 3128 - protein, 1365 aa, Unknown
  Description of Unknown: uncultivated organism sequence
  Category: MG91 effectors
  Description: MG91-320 effector
MGDKKYYLGLDMGTNSVGWAVTDEKYCLLKAKGKDLWGIREFDEASTAVDRRMHRVSRRRRQRQVVRIGLLKDYFSDQIEKVDPYFYQRLENSKYYLEDKDEQVKDKNALFNDPGFNDRDYFKNYPTIFHLRKELIENPAPHDVRLVFLALLNMFKHRGHFLNAGLDSEGDSLGNMSEIYREFAEITADDLDFPIETKGEKIEDILSSRDHSRSVKSEMLIELFGFDKKDKKRREFVRAICGLKTDTTKLFGDDQGFSSEEKTEFSFSDAAYDEKVPDIVSIIGEDRYYILELMKAIYDKGTLSEILKGSDYLSQARVASYNKHSDDLLRMKKVVRKYGSPEEYDFFFRSTEDGSYSSYVGTVNSGKKKRRSMKGDFISETNKYMTKLKKDHEDDQEIDTILNDIALENFMPKQLTSSNGIIPYQVHLKEMKKILGNAEGYLPFLIEKDESGLSVSERIIQLFSFQIPYYVGPITSKSQSDGGNGWVVRKDEGTVLPWNIHDKIDMEKTQEEFIKKLIRKCTYISGETVLPKCSLLYEKFSVLNEINNLRIDNERIDPELKQDIYNDLFLAGKAVTKKQLMKYLMNRGLITQADQVSGADITSESNARFNSALSSYGKFISIFGSDKMKEDQYQEMAEHIIYLVTIFGDSKSVLRDYLKREYGTVLNEEQIKKITGMKFRDWGRLSKAFLELHGCNKADGESKSIVRAMWDNNLNLMELINSDEYTYKDELFEKTNVQTKCLAEFKAEDLDEYYFSAPVKRMIWQTVLLIKEIEYIMGGAPDRVFIEMTRKPEDKPTRKDSRKKKFMDLYSNIKEEQKYWKDLIETSDSNGTIRSKKMFLYLTQMGRDMYTGKQIELDRLFDDNLYDIDHIYPRHFVKDDNLQNNLVLVDKRKNARKSDNYPLEKEISSNPEVVALWKTLHEKKLITDEKYRRLTGRTPFTDEQKAGFIARQLVETGQGTKGVADILKMLLPKDTTIVYAKASNASEFRHKFDLPKSRLVNDFHHANDAYLNIVVGNVYYTKFTQNPLNYIKNEYRKNSQNAEYNLDKMFDRDVIRGDQIAWKASKKDGEAGTITTVKKMMQKNTPLLTRYSFVAHGGITRKDTIWGKEVAKTEGYIPLKASDKKLKDVTKYGGFNNVSGAYFFLVEYEKKRKKERSLEVVPIYLVDRFENNVSELEKYCREELGLANASVRMSKIRIQSLISIDGYRLHISGKSENRILLRNACSMCLNTDWIKYIQKIEKYVETEVLDEEILNKQKNERLYNILKEKHLYQIYSYRPNSIGEKLEKAEVIFCGLDVKKQCSALYQLLQLTSIGPAIGDLTLLKESKNSGTMRMSKNISGNKDLYLINQSVTGVYENKIDLLTV

SEQ ID NO: 3129 - protein, 1359 aa, Unknown
  Description of Unknown: uncultivated organism sequence
  Category: MG91 effectors
  Description: MG91-321 effector
MRETGKDYYLGLDMGTNSVGWAVTDENYVLMRAKGKDLWGIREFDEALTAVDRRTHRVARRRRQRETARIGLLKEYFHDAIAEVDPDFYQRLDNSKYHEEDKDSAVKGKNGIFNDANYNDKDYFKQYPTIFHLRKELIESTEKHDVRLVYLALLNMFKHRGHFLNAGLSTESENTMDTAYHNFVETAAQTIECNFMETVDIEKIKEILGSRDYSRSKKAELVAQLLHVDSKNKVQMACIKCICGLKVTAAAIFGDKMAADEEKKTDICFSDFGYDEKVPVILEIVGEENFELVLAMQEIYDIGSLAGIMKDSLYLSMARVKEYEQHGKDLRILKGVVKKYGTKEEYDTLFRTMEEGTYSAYVNSVNTKKKSRRDVKKRTRDEFYGRLKKIISKMPQNDSDVLYIKDKMEKEAFLPKQLTASNGVIPNQIHAREMKKILQNAEIYLPFLKEKDTSGLTVSERILKLFSFQIPYYVGPVSEKSKLNGGNGWVVRKEEGTVLPWNIEEKIDMTATSREFVERMVRRCSYLSDERVLPKGSLLYERFCVLNEINAIKVDGVKIPVEIKQDLYSKYFKKGKKVTKKKIAEFLIARGVIKEDQTELISGIDIAVNSTLSTYAKFYAIFGEKMEQDSYKKMVEQIVEWCTIYGDAKKFLEQKIKECYGNILTQEEIKRITGFKFRDWGRLSKEFLELSGCSKATGEVMPLISMMWETNDNLMELLDDNYYTYREALEEKQNNAFKLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQRGRCMYTGHPIDLEDLFKDNRYDIDHIYPRHFVKDDNIMNNLVLVEKEKNAHKSDNYPLEEEIYKKQLPMWKDLHQCKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTILTVKKMMAKNTPMLTRLSFEGKGGLADQTLYSAEKAKGNGYIPLKTSDSKMQDVTKYGGFNSVSTAYFFLVEHELKGKKVRTLETVPIIWRDRIEKDETMLLKYCTDVLELKNPSIRVKKIKLQSYIKKDGYYMYITGKTNKQITTKNAVELCVNQRWIDYIKIIEKTVEKKKEECEEIDYDKNVEFYDLLLTKHTQEIFSNRPNPVGAKLKQGRDKFVSLTLLEQCRVLYEILQLSIIGNTRADLQLIGGAAISGVMLLSKNITDSKEFILINQSVTGLFEQKVDLLTV

SEQ ID NO: 3130 - protein, 1353 aa, Unknown
  Description of Unknown: uncultivated organism sequence
  Category: MG91 effectors
  Description: MG91-322 effector
MEKDYYLGLDMGTDSVGWAVTDENYNLIRAKGKDLWGVREFDSAKPAADRRSYRISRRRRQREQVRLGMLKSIFADAIKEKDPLFFIRLENSKYWKDDKNSKINTKNVLFDDPGYTDADYFKEFPTIFHLRLKLMNDDSGRYLSDPRFVYLACLQLFKHRGHFLSDISDETDPSDLSSTYERFKSLYCELTGYEFTEKDVAADDIMNVLSDRNLSRTAKKEKLIDVFSFSKSDSSKTECLKSICGLESDACKIFPDLKTEDIKKLSFNFSKSDYEEKSAELNESVGDEYFELISILKDIYDKGTLADILKGKKYLSEARVEDYNKHKKDLVLLKSVYRKYKTQDEYNEMFRDPTKGYGAYIGSNFTKDKKTSRRGSKSRDVFYDYLKKSLKGLEEDPDVKTIFDDIAKENFLVKQLTSSNGVIPNQVHLKELKKILSNAENYLPFLKETDESGLSASQRIISIFSFTIPYYVGPVSELSEKNGGNGWVVRKEDGKVYPWNFEDKINISETKRRFIDRLINECTYISGEKVLPKQSLIYQKFAMLNELNSVRINGERLDVEFKQKAFKELFSKGKQVTLNEFKNYLNNNGINIDEKSEISGVGKSSEMTRFNNKLSSYQVFHSVFGDKLEDKKYYDAAENIIYLGTIYADDKKTFKKAIEEKYGDFLTPDEIKRVSGLKFKDWGTLSAALFNLQGAEKSTGEVMTLIDALWNTQLNFMELINSDAFSYKEELEKYKKKGEGTIQNFKFEELNDYYFSAPVKRMIWQTVLIVREIEHVLGKPPVKMFVEVTRHDEEKEKIPPSRKDTFLSLYKNIKDESHDWKAIIEKADESGVIRSQKMYLYLSQMGRDLYTGKEIELDELFTTKYDIDHIIPQSLKKDDSILNNKVLTSKDFNNNIKQDNPLCEAIDDAHYAERKKLWDRLHNYNLINDEKYKRLTNRKGFSEEDLEGFIARQIVETSQAVLGVINIFKEIMPDTKIVFSKAKPISDFRKNEIGWLKSRTLNDYHHAHDAYLNIVVGNVYNTKFTDNPRNFIKKERQKDLNPNYHMNKVFWYNVERGGKVAWIAGEDGTKKTVLKTLAKNSELMTRQSFEQTGGLCNQQITNKDDAGSGIGYLPVKMGEDISKYGGYAKISQSYFFLVEHTFKKKRIRTIETVPAYLKSQIESDPDALKRYCAEKLGLVDPDIRLRRINYQSLAKYNGFYVTICSKTGDRFQVANAVRLTLSKEWNNYIKKLEKTEGDEEITEEKNIELYDILTDKHLNSIFLKRPNPVGENLKNGREKFVSLSKKEQVSTLNNILLFTGFASAGKADISSIGGSKNAGAMAVSKNVNNADEFILIENSVTGIYSVRKDLKTI

SEQ ID NO: 3131 - protein, 1358 aa, Unknown
  Description of Unknown: uncultivated organism sequence
  Category: MG91 effectors
  Description: MG91-323 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDAFQKDVRLVYLAVANMFKHRGHFLLSGIGSESSKQTITDLYNQVSGLITEEYGISLKTDIAGTDFEQVLCSREYSRTRKLEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3132 - protein, 1358 aa, Unknown
  Description of Unknown: uncultivated organism sequence
  Category: MG91 effectors
  Description: MG91-324 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSGEKSRRNYKVRKQEDLYNSIKKLLKSVDNVYDTDIEYIKNEMDKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKRIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKMYDIPKSRLINDFHHAHDAYLNIVVGNIYFTKFTSNPLNYIRKECSSKDNKYQYNLGNMYKWDVKRDGKTAWIAAKEGETGTIATVKKMLSRNTHTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYIQLCLNGKWVDYIHKLEKYQDKGFIDNVITDEKNVELYNVLCEKHNVGIYTMRPNPVGDRIKNGYDKFVDLTIEEQIKLLIEIIKLTCVGIVSADLTLIGGAAISGKMLMSKNITDANECILINQSVTGLYENRIDLLRV

SEQ ID NO: 3133 - protein, 1358 aa, Unknown
  Description of Unknown: uncultivated organism sequence
  Category: MG91 effectors
  Description: MG91-325 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFYVEDKQDNVKDKNGIFNDKNYKDANYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWGKRLEPGQGLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3134 - protein, 1358 aa, Unknown
  Description of Unknown: uncultivated organism sequence
  Category: MG91 effectors
  Description: MG91-326 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDANYYKQYPTIFHLRKELIEDVSQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHVSELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3135 - protein, 1358 aa, Unknown
  Description of Unknown: uncultivated organism sequence
  Category: MG91 effectors
  Description: MG91-327 effector
MRETGKDYYLGLDMGTNSVGWAVTDENYVLMRAKGKDLWGIREFDEALTAVDRRTHRVARRRRQREIARIGLLKEYFHDAIAEVDPDFYQRLDNSKYHEEDKDSAVKGKNGIFNDANYNDKDYFKQYPTIFHLRKELIESTEKHDVRLVYLALLNMFKHRGHFLNAGLSTESENTMDTAYHNFVETAAQTIECNFMETVDIEKIKEILGSRDYSRSKKAELVAQILHVDSKNKVQMACIKCICGLKVTAAAIFGDKMAADEEKKTDICFSDFGYDEKVPVILEIVGEENFELVLAMQEIYDIGSLAGIMKDSLYLSMARVKEYEQHGKDLRILKGVVKKYGTKEEYDTLFRTMEEGTYSAYVNSVNTKKKSRRDVKKRTRDEFYGRLKKIISKMPQNDSDVLYIKDKMEKEAFLPKQLTASNGVIPNQIHAREMKKILQNAEIYLPFLKEKDTSGLTVSERILKLFSFQIPYYVGPVSEKSKLNGGNGWVVRKEEGTVLPWNIEEKIDMTATSREFVERMVRRCSYLSDERVLPKGSLLYERFCVLNEINAIKVDGVKIPVEIKQDLYSKYFKKGKKVTKKKNAEFLIARGVIKEDQTELISGIDIAVNSTLSTYAKFYAIFGEKMEQDSYKKMVEQIVEWCTIYGDAKKFLEQKIKECYGNVLTQEEIKRITGFKFRDWGRLSKEFLELSGCSKATGEVMPLISMMWETNDNLMELLDDNYYTYREALEEKQNNAFKLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQMGRCMYTGHPIDLEDLFKDNRYDIDHIYPRHFVKDDNIMNNLVLVEKEKNAHKSDNYPLEEEIYKKQLPMWKDLHQRKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTILTVKKMMAKNTPMLTRLSFEGKGGLADQTLYSAEKAKGNGYIPLKTSDSKMQDVTKYGGFNSVSTAYFFLVEHELKGKKVRTLETVPIIWRDRIEKDETMLLKYCTDVLELKNPSIRVKKIKLQSYIKKDGYYMYITGKTLNRIIIKNAVQMCLQQKWIVYIKNIEKAIQKKTIDATITYDANLELYNLIERKYKYEIFKNRPNPMGDKIEQGKKLFEEKSLLEQSKILYELLQLSAIGNVKADLQLIGGSASSGVMLIPKNITDSKEFILINQSVTGLFEQKVDLLTV

SEQ ID NO: 3136 - protein, 1342 aa, Unknown
  Description of Unknown: uncultivated organism sequence
  Category: MG91 effectors
  Description: MG91-328 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALVNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTISERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTDAQIKRILGIKFRDWGNLSKKFLELQGCSKETGKVNSLIRMLWETNDNLMELLAQDSYTFKEELENMQESTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLEVLKLSNPDIRVRKILIQSLIKRNGYYMQITGKTGNQLYVRNTVSLCLKQEWVNYIKKLEKGNDENITKDKNLVLYDILVDKHNNTIYSQRPNPVGEKLVKRREEFINLNLNDQVTVLLEILKLTQIALGGANLKLIGEAEKTGVMLISKDITTLDEMLLINQSVTGLYEQKVNLLTV

SEQ ID NO: 3137 - protein, 531 aa, Unknown
  Description of Unknown: uncultivated organism sequence
  Category: MG91 effectors
  Description: MG91-329 effector
MNEVFVLELPLRVEKYQADILNKRYEQLRQLYNYVQGKLRRQYSYFEQMKEFKACKTFKEKRDFFRSHPFYINETLKNNKTPFKVSFDEYGIKGYVEKLAQKLVGGNKSYADFGFTTLILDHLGASIWSAWNKKLYDLKAKHISYKKYDELNSFSSRRQVVHGVVYFSGIELHLDTMELSIKMNGKQGNNAKFITLKIQHNPKHADYELRALKGGLESVKVVKVVRRMVRSQYKYYVQLTIEGEKPQKGRTLGNGRVGIDLGPTTVAVSGENIVSIDKLASKCDNIQEEITRLSRKIDRSRRANNPQNFNEDGTIKRGVKLVWKKEKNLKRYSKLKRELAELRRKQAAIRKQQHIERANALLKEGDTFIVENNPVNAWVRRAKETKIDEKTGKYKSKRGSGRSVGNHAPAMFVDILENKVKSLGGRFERVNTQNAASQYDFTTDSFKTGDEKHKLNERAITLSNGDTHQRDMLAAFNLQHLKLDETKTKQYDTEAMAADYDRFCKLEREEIQRYKNKEKKDDRSTIGAEKL

SEQ ID NO: 3138 - protein, 1352 aa, Unknown
  Description of Unknown: uncultivated organism sequence
  Category: MG91 effectors
  Description: MG91-330 effector
MTAFKYYLGLDMGTNSMGWAATDPEYRLLKAKGKDLWGIREFNEASGAVERRTHRISRRRRQREQVRIGILKDYFHDAICEVDPGFFRRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRNPFSDEQKAGFIARQLVETSQGTKGVANILRQLLPGSKIVYAKASNVSEFRRTRDDIPKSRLVNDFHHAHDAYLNIVVGNVYYVKFTQNPLNFIKKDYDNYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTSVTGAYFFLVEHAEKKKRIRTIESVPVYLAQKIEQNPDELKKYCEEILGLIDADIRLKKIKIGSLIKRNGYFCYITGKTGKQLIVRNAVNLCLKNEWIKYISKLEKVKEKDAVDKIITKEKNEVLYSELIQKFKHGIFSKRPNPVGDKLEKGSEKFSNLSIKEQCTVLCQILQLAAVLGSECDMTLLGESAHCGKMLISKKIGDEEIYLINQSVTGLYEKKINLHTV

SEQ ID NO: 3139 - protein, 1358 aa, Unknown
  Description of Unknown: uncultivated organism sequence
  Category: MG91 effectors
  Description: MG91-331 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHVSELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWEINYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSLRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3140 - protein, 1352 aa, Unknown
  Description of Unknown: uncultivated organism sequence
  Category: MG91 effectors
  Description: MG91-332 effector
MTAFKYYLGLDMGTNSVGWAATDPEYRLLKAKGKDLWGIREFNEASGAVERRTHRISRRRKQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIPKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3141 - protein, 1359 aa, Unknown
  Description of Unknown: uncultivated organism sequence
  Category: MG91 effectors
  Description: MG91-333 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLLDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVCAKAGNVSDFRRNRELPKSRLVNDFHHAHDAYLNIVVGNVYYVKFTQNPINYIKNSYNKDMNKNNYNLSRMFDWDVKRGDEVAWIAQKQDGATGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDIRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3142 - protein, 1352 aa, Unknown
  Description of Unknown: uncultivated organism sequence
  Category: MG91 effectors
  Description: MG91-334 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEETFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3143 - protein, 1352 aa, Unknown
  Description of Unknown: uncultivated organism sequence
  Category: MG91 effectors
  Description: MG91-335 effector
MLEKPYYLGLDMGTNSVGWAVTDQHYNLLKAKGKDLWGIREFTEADTSVERRTHRISRRRRQREQARIGLLNDYFHDTIIAIDPSFFQRLENSKYHLEDKDQNVRYKYNIFNDPDYTDVDYYTQYPTIYHLRKELLENPKPHDVRLVYLALLNMFKRRGHFLNAGISDGNNERSLKDAYINFAISVSELTEDYFNQDVDYSAIEEILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLTGILKGYTYLSQARVAAYNKHKHDLKLLKSSIKKYCTKEEYNNFFNSDADGSYASYIGSFNSGSKERRVGSKRTSEDLYKEIKKLLKDANKSDPAINEIFTSIETESFLPKQLTASNGIIPNQVHSKEMAKILSNAENYLPFLKDTDENNLSISNRILQLYKFQIPYYIGPVTEKSQRDGGNGWVIRKDNGRVLPWNIEEKIDVKATSEAFISRMVRRCTYMNGKQVLPKASLEYESFRVLNEINNLRIDGERIPVALKQDIYTDLFQKGKKVTKKQLCNYLVTRGLIESSEQVTGIDIAINNSLSTYGKFKAILGEDIKLDHIQHMIEDIVFWCTVYGDSKQFLKEQIEDKYKEKLSPEQMKRILGFKFKDWGNLSKEFFELKGADKSTGEAISIIRALWDNNLNLMELINSPEFDFKERLTDYQTNSLKTLSDFEPEDLNEYYFSAPVRRMIWQTTLIIKELVHVLGKEPDRIFIEMTREKDASRGRTLSRKKKFEDLYKNVKDENTDWAKVIEHANESGTIRSKKMYLYLTQKGRCMYTGKHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKKDGAAGTISTVKKMLSRNTPLMTRLSYEGKGALANETLYSAEKAKGEGYIPFKSSDAKIQDVTKYGGFTSVTGAYFFLVEHDEKKKRIRTIESVPLYLANKIEKDSSELERYCDKLGLINYDIRVRKIKIGSLLNRNGYFAYLTGKTGKQLILRNATNLCLDKKWTIYIKKIEKYKEANVLDSIITSEENIKLYNELLNKFTVGIYGRRPNPIGEKMDSARDKFASLSIENQCLALYQILQLSAILGNESDLQLIGASTHAGKMLISKKIGTDEIYLINQSPTGLFETKIDLQTI

SEQ ID NO: 3144 - protein, 1331 aa, Unknown
  Description of Unknown: uncultivated organism sequence
  Category: MG91 effectors
  Description: MG91-336 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTGAQIKRILGIKFRDWGNLSKKFLELQGCSKETGEVNSLIRMLWETNDNLMELLAQDSYTFKEELENMQESTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLDVLKLSNPDIRVRKILIQSLIKRNGYYMQITGKTGNRMYVRNMVSLCLVQDWVNYIKKLEKDKDENISKEKNINTIYNTRPNPVGDLLIKRRSDFIELKITDQVIILLEILKLTQTALGSANLKLIGEAEKTGVMLISKDITALDEMLLINQSVTGLYEQRVNLLTV

SEQ ID NO: 3145 - protein, 1358 aa, Unknown
  Description of Unknown: uncultivated organism sequence
  Category: MG91 effectors
  Description: MG91-337 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIHKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3146 - protein, 1358 aa, Unknown
  Description of Unknown: uncultivated organism sequence
  Category: MG91 effectors
  Description: MG91-338 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHGEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITYANECILINQSVTGLYENRIDLLRV

SEQ ID NO: 3147 - protein, 1352 aa, Unknown
  Description of Unknown: uncultivated organism sequence
  Category: MG91 effectors
  Description: MG91-339 effector
MTAFKYYLGLDMGTNSVGWAATDPEYRLLKAKGKDLWGIREFNEASGAVERRTHRISRRRKQREQVRIGILKDYFHDAICEVDPSFFQRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENIQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGYEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVTGAYFFLVEHTEKKKRIRTIESVPVYFVQKIEKNPGELKKYCEEILGLVDADIRLKKIKIGSLIKRNGYFCYITGKTGNRLSVRNAVNLCLKNEWIKYISKLEKVKEKDTIDEIITKEKNEVLYSELIQKFKHCIFSKRPNPVGDKLEKGSEKFSNLSIKDQCAVLCQVLRMAAILGSECDMTLLGESSICGEMKISKKIGDEEIYLINQSVTGLYEKKINLHTV

SEQ ID NO: 3148 - protein, 1358 aa, Unknown
  Description of Unknown: uncultivated organism sequence
  Category: MG91 effectors
  Description: MG91-340 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIYKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3149 - protein, 1352 aa, Unknown
  Description of Unknown: uncultivated organism sequence
  Category: MG91 effectors
  Description: MG91-341 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIDDIVFWCTVYGDSKQFLKEQIEDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLTSNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3150 - protein, 1358 aa, Unknown
  Description of Unknown: uncultivated organism sequence
  Category: MG91 effectors
  Description: MG91-342 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQIEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYHDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3151 - protein, 1358 aa, Unknown
  Description of Unknown: uncultivated organism sequence
  Category: MG91 effectors
  Description: MG91-343 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDANYYKQYPTIFHLRKELIEDVSQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHVSELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKLTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSGFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYVQLCLNGKWVDYIHKLEKYQDKGFIDNVITDEKNVELYNVLCEKHNVGIYTMRPNPVGDRIKNGYDKFVNLTIEEQIKLLIEIIKLTCVGIVSADLTLIGGASISGKMLISKNITDAKECLLINQSVTGLYENRIDLLRV

SEQ ID NO: 3152 - protein, 1347 aa, Unknown
  Description of Unknown: uncultivated organism sequence
  Category: MG91 effectors
  Description: MG91-344 effector
MEEKEYYLGLDMGTNSVGWAVTDPQYRILRAKGKDMWGIREFESAETAEKRRGHRTSRRRRQREVVRMGLVKDYFSDAINNVDGNFYARLENSKYHLEDKDEAVRNKNGIFADEHYTDKEYYAEYPTIYHLIMELINNPAPHDVRLVYLAVANLFKRRGHFLNAGLSEDGGNQSMQTAYDEFNTTCNETIGFSFPGIDATQIEEVLKNRNYSKTVKSEKLAELLGVEKKEKQRIEILRAIAGRKVNAKVIFPNVETEDKVEFSFSDAAFDDNATELMTLLGDECYSLVLCMREMYDIGTLAEIMHGYQYLSESRMADYQKHHEDLVLLKSVIKSECTQKQYDELFRLDGEGSYSAYVNSTLAKNHKQRRSMKGRTRDDFYKKVRGLIGKSSNPDAIKICTEIENETFMPKMLTSANGIIPNQVHYKELKAILSNAEKYLPFLLEKDESGLTTSDRIQRLYKFRIPYYVGPVSNRDGKGNGWAVRKEEGMVLPWNLEEKIDLSKTKEAFIENLIRRCTYISDEKVLPKNSLIYEKFTVLNEINNIRINDERISVELKQDIYNELFKKGKKVTRKTLVKYLINRGVIEAENQISGIDIAINNSLSSYGKFKAVFGESMDTDTTKKMVEDIIKTSTIYGDDKRELKNILRDKYGEILSEDQIKRIAGFRFKDWGRLSRAFLELAGADRSTGEVTSIIQALWESQLNLMELLHSEDYTFGESLNEKLVKNEKSLSEITAEDLDDYYFSAPVKRMAWQTILLIKEISKIKGCEPSKIFIEMTRTDEEKGDKGRKNSRAKELTALYKNIKKEGKAWIELIGKEDASGRLKSKKMYLYIKQMGRDMYTGEQIDLDRLFDDNLYDIDHIYPRHFVKDNNIENNLVLVNKAKNSRKSDNYPLDSDIVRNPKVRELWEMLHTNHLMSDEKYHRLTSRKAFTDEDLAGFIARQLVETGQATKGVADLLKELTSSEIIYSKAGNVSDFRHAYDIPKSRIVNEFHHAHDAYLNIVVGNAYYTKFTSNPLNYIRNEYKKNTKENNYHLNKIFESTISRNGYVAWLAGSDKNPGTIQTVKKMLSRNTPLMTRMTFVVHGSIADETLYGKNTAKEDSYLPLKGSDPRMSVEKYGGFNKASGAYFFLVEHELKGKKVRTIETVPVYLMKKLSDERELQKYCEEKLGLINPSIRLKQIKMQSLIKLDGYFVNVTGRTNQRLTLRNAVNLKLDKEDIYIIHLVEKCIGEERDDRLSEESILSLYQTLTEKQASGIYRNRPNSVYEKLNEGMIRFNNLERKQQIKVLANILNLTMVGKAQADLKDIGGSANSGVMLMAKKINNYNEVKLINQSVTGLYQTEVDLLTV

SEQ ID NO: 3153 - protein, 1352 aa, Unknown
  Description of Unknown: uncultivated organism sequence
  Category: MG91 effectors
  Description: MG91-345 effector
MTAFKYYLGLDMGTNSVGWAATDPEYRLLKAKGKDLWGIREFNEASGAVERRTHRISRRRKQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRSPFSDEKKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGDRLSVRNAVNLCLKNEWIKYISKLEKVKEKDTVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3154 - protein, 1359 aa, Unknown
  Description of Unknown: uncultivated organism sequence
  Category: MG91 effectors
  Description: MG91-346 effector
MRETGKDYYLGLDMGTNSVGWAVTDENYVLMRAKGKDLWGIREFDEALTAVDRRTHRVARRRRQRETARIGLLKEYFHDAIAEVDPDFYQRLDNSKYHEEDKDSAVKGKNGIFNDANYNDKDYFKQYPTIFHLRKELIESTEKHDVRLVYLALLNMFKHRGHFLNAGLSTESENTMDTAYHNFVETAAQTIECNFMETVDIEKIKEILGSRDYSRSKKAELVAQILHVDSKNKVQMACIKCICGLKVTAAAIFGDKMAADEEKKTDICFSDFGYDEKVPVILEIVGEENFELVLAMQEIYDIGSLAGIMKDSLYLSMARVKEYEQHGKDLRILKGVVKKYGTKEEYDTLFRTMEEGTYSAYVNSVNTKKKSRRDVKKRTRDEFYGRLKKIISKMPQNDSDVLYIKDKMEKEAFLPKQLTASNGVIPNQIHAREMKKILQNAEIYLPFLKEKDTSGLTVSERILKLFSFQIPYYVGPVSEKSKLNGGNGWVVRKEEGTVLPWNIEEKIDMTATSREFVERMVRRCSYLSDERVLPKGSLLYERFCVLNEINAIKVDGVKIPVEIKQDLYSKYFKKGKKVTKKKIAEFLIARGVIKEDQTELISGIDIAVNSTLSTYAKFYAIFGEKMEQDSYKKMVEQIVEWCTIYGDAKKFLEQKIKECYGNILTQEEIKRITGFKFRDWGRLSKEFLELSGCSKATGEVMPLISMMWETNDNLMELLDDNYYTYREALEEKQNNAFKLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQRGRCMYTGHPIDLEDLFKDNRYDIDHIYPRHFVKDDNIMNNLVLVEKEKNAHKSDNYPLEEEIYKKQLPMWKDLHQRKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTILTVKKMMAKNTPMLTRLSFEGKGGLADQTLYSAEKAKGNGYIPLKTSDSKMQDVTKYGGFNSVSTAYFFLVEHELKGKKVRTLETVPIIWRDRIEKDETMLLKYCTDVLELKNPSIRVKKIKLQSYIKKDGYYMYITGKTNKQITTKNAVELCVNQRWIDYIKIIEKTVEKKKEECEEIDYDKNVEFYDLLLTKHTQEIFSNRPNPVGAKLKQGRDKFVSLTLLEQCRVLYEILQLSIIGNTRADLQLIGGAAISGVMLLSKNITDSKEFILINQSVTGLFEQKVDLLTV

SEQ ID NO: 3155 - protein, 1359 aa, Unknown
  Description of Unknown: uncultivated organism sequence
  Category: MG91 effectors
  Description: MG91-347 effector
MLNTPYYLGLDMGTNSVGWAVTDKNYNLLRAKGKDLWGIREFSDSATSVDRRSYRIRRRRRQREQARIGLLKYYFNDSIIAKDPSFFQRLENSKYHLEDKDEAVKYKFNIFNDKTYTDIDYYTQYPTIYHLRKELLESSEPHDVRLVYLALLNMFKHRGHFLNAEIGDVAEERKLKDAYIDFCSCVSELTNESFNLDIDYSAVEEILSSRDISRTKKSEALASILNIDVKNKKYKEYVKAICGLKVNAYTLFSEQLSDEVKRIDICVSDASFDTKREDYISILGEDLFQIILYIKEIYDIGSLAGILKGYSYLSFARVATYEKHKSDLRKLKDCIRKYCSKEDYNQFFNSDAAGFYASYIGSFNSGKKQRRVGKNTTSEDLYKEIKKILKNADKNDPEIIDIFSSIDTESFLPKQLTASNGVIPNQVHYKEMAKILSNAESYLPFLREKNESNLSVSERILQIYKFQIPYYIGPVTEKSHRDGGNGWVIRKSNGRVLPWNINEKIDVKATSEAFISRMVRRCTYMNGAQVLPKASLEYESFRVLNEINNLRIDGERIPVDLKQAIYIDIFQKGKKITADILHKYLFNKGYIQSSEQVTGIDININNSLSTYGKFKVIFGEDIKLDSVQHMIEDIVFWCTVYGDSKKFLQEQIEEKYSDKISKEQLKRILGFKFKDWGSLSKEFFELKATDKSTGENISIIRALWENNLNLMELINSSKFNFKERLEEYRITSLKTLSDFEPEDLREYYFSAPVRKMIWQTMLVIKELVHVLGHEPERIFIEIPRDKDPSIGRTISRKKKFEELYKNVKDESVDWMNVIEHADDSGSLRSKKMYLYLTQKGRCMYTGEHIELSDLFNKSLYDIDHIYPRHFVKDDNIDNNLVLVKREKNAHKSDNYPLEAEIFNNQKKMWAQLRKEDFINEEKYKRLMGRNPFTDEQKAGFIARQLVETQQGTKGVAELLQQLLPNSKIVYTKAGNVSDFRHSREIPKSRLINDFHHAHDAYLSIVVGNVYYVKFTQNPINFIKNAYNKDSSKNNYNLTRMFDWDVKRRDEVAWIAQNKNGTVGTIAIVKKMLKRNTPLMTRLSYEGKGGLTKETLYSAEKAKGEGYIPFKSSDKKMQDVTKYGGFTSVKGAYFFLVEHDEKKKQIRTIESVPLYLADKIEKDPAELERYCQKLGLVNYNIRVRKIKIGTLIKRNGYFAYLTGKTGKQLILRNATNLCLDSKWGTYIKKIEKYKDTGVLDNTLDTDTNIKLYNELLDKFTTGIYGKRPNPIGDKMLSAKNTFTSFTLDNQCNLIYQILQLSKILGFETDLSLLHTNKKSDKPTREGGMQISKKVSNTTSMYLINQSPTGLFEKQIDLLTV

SEQ ID NO: 3156 - protein, 1359 aa, Unknown
  Description of Unknown: uncultivated organism sequence
  Category: MG91 effectors
  Description: MG91-348 effector
MRETGKDYYLGLDMGTNSVGWAVTDENYVLMRAKGKDLWGIREFDEALTAVDRRTHRVARRRRQREIARIGLLKEYFHDAIAEVDPDFYQRLDNSKYHEEDKDSAVKGKNGIFNDANYNDKDYFKQYPTIFHLRKELIESTEKHDVRLVYLALLNMFKHRGHFLNAGLSTESENTMDTAYHNFVETAAQTIECNFMETVDIEKIKEILGSRDYSRSKKAELVAQILHVDSKNKVQMACIKCICGLKVTAAAIFGDKMAADEEKKTDICFSDFGYDEKVPVILEIVGEENFELVLAMQEIYDIGSLAGIMKDSLYLSMARVKEYEQHGKDLRILKGVVKKYGTKEEYDTLFRTMEEGTYSAYVNSVNTKKKSRRDVKKRTRDEFYGRLKKIISKMPQNDSDVLYIKDKMEKEAFLPKQLTASNGVIPNQIHAREMKKILQNAEIYLPFLKEKDTSGLTVSERILKLFSFQIPYYVGPVSEKSKLNGGNGWVVRKEEGTVLPWNIEEKIDMTATSREFVERMVRRCSYLSDERVLPKGSLLYERFCVLNEINAIKVDGVKIPVEIKQDLYSKYFKKGKKVTKKKIAEFLIARGVIKEDQTELISGIDIAVNSTLSTYAKFYAIFGEKMEQDSYKKMVEQIVEWCTIYGDAKKFLEQKIKECYGNVLTQEEIKRITGFKFRDWGRLSKEFLELSGCSKATGEVMPLISMMWETNDNLMELLDDNYYTYREALEEKQNNAFKLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQMGRCMYTGHPIDLEDLFKDNRYDIDHIYPRHFVKDDNIMNNLVLVEKEKNAHKSDNYPLEEEIYKKQLPMWKDLHQRKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTILTVKKMMAKNTPMLTRLSFEGKGGLADQTLYSAEKAKGNGYIPLKTSDSKMQDVTKYGGFNSVSTAYFFLVEHELKGKKVRTLETVPIIWRDRIEKDETMLLKYCTDVLELKNPSIRVKKIKLQSYIKKDGYYMYITGKTNKQITTKNAVELCVNQRWIDYIKIIEKTVEKKKEECEEIDYDKNVEFYDLLLTKHTQEIFSNRPNPVGAKLKQGRDKFVSLTLLEQCRVLYEILQLSIIGNTRADLQLIGGAAISGVMLLSKNITDSKEFILINQSVTGLFEQKVDLLTV

SEQ ID NO: 3157 - protein, 1359 aa, Unknown
  Description of Unknown: uncultivated organism sequence
  Category: MG91 effectors
  Description: MG91-349 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEEILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGSGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIELDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNEYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDAKIQDVTKYGGFTSVTGAYFFLVEHDEKKKRIRTIESVPLYLADKIDKNSSELERYCDKLGLVNYDIRVRKIKIGSLLNRNGYFAYLTGKTGKQLILRNATNLCLDKKWTIYIKKIEKYKETNLLDSIITSETMVNLYNELLNKFTVGIYGRRPNPIGEKMDSAKNTFTSYTLDNQCNLIYQILQLSKILGFETDLSLLRTNKQSSKPTREGGMQISKKIDNTTSMYLINQSPTGLFETKIDLQTI

SEQ ID NO: 3158 - protein, 1352 aa, Unknown
  Description of Unknown: uncultivated organism sequence
  Category: MG91 effectors
  Description: MG91-350 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQEVNYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAILGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNEYYFSAPVRRMIWQTTLIIKELVHVLGEEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWVAQKQDAAAGTISTVKKMLSKNTPLMTRLSYEGKGALANETLYSAEKAKGEGYIPFKSSDAKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3159 - protein, 1349 aa, Unknown
  Description of Unknown: uncultivated organism sequence
  Category: MG91 effectors
  Description: MG91-351 effector
MKNYFLGLDMGTNSVGWAVTDDNYNILRAKGKDLWGIREFESANTAEERRMHRTARRNRQREVVRRGYLQSYFADAINDVDPNFFARMQNSKYYLEDKAPEARVKDVLFNDKDYHDKDYYEEYPTIYHLRMDLINNPNPHDVRLVYLAIANIFKHRGHFLNQGLGESNGESNMQIAYDRLISMLSSNYNIELPELDADQITDILKDRRYSKTVKSEKLKELIPYHDVENKKFYSEIINAISGRKVKGKNLFPELEGEDNIDFSFAESSFDDNLSEFVSKIGEERYALIEILREIYSIGSLAEIMHGCRYLSESRVKDYDKHHSDLKKLKNVIKKYCDKTVYDEIFRSDDNGTYSAYVNSVNSSTSGKIRRNMKDRKRDDFYSKIKKIVGGMPKEDSDVQDILSDIDRETFMPKMLTSDNGIIPNGVHARELSAILHNAEQYLDFLRAEDENGLSVSDKILQLFKFRIPYYIGPVANYNGKGNGWAVRKANGPVLPWNISEKIDIKATKEKFIERLIRDCTYISGEKVLPKGSMLYERFMVLNEINNIRINDERIPVELKQSIYTDLFERGKRVTKNQLFKYLNNKGLVQDKEQITGLNDQIAGTLTSYGRFYQIFGEKLKEDSIKAQVEEIIKLCTIYGDDKKELANVLRDTYGNLLSDDEIRRICGYKYKDWGRLSRAFLELEGCNKQTGEITTLIQELWNTSYNLMELLHSPDYTFSETLDKQTRSSEKLLSEITPEDLNEFYFSAPVRRMVWQTILLIREITHIMGNEPGKIFIEMTRTDEEKGENGRKQSRKNELTELYKSVKDDLQNWKELIAQEDESGRLRSKKMYLYILQMGRDMYTGEPIDLDNLFNDNIYDIDHIYPRQFVKDNNLQNNMVLVNKQANSRKTNNYPLDASIASNSKVQDLWKTLHEHHLMNDEKYHRLTRRTPFSDEDKAGFIARQMVETGQATKGVADLLKELMPESRIVYSKAGNVSDFRRDYGIVKSRIVNDFHHAHDAYLNIVVGNVYLTKFTDNPLNFVKKEYSRDPEKNHYHLDKMFIWDVKRGNYTAWVKGKEGTISTVKKTLSKNSPILTRMTFEAHGQISEQTLIGKKTAKAGVYLPLKGNDARMTVEKYGGFSSAKGAYYCLVEHGTKAKRIRSIETVPIYKAAEIGDSKDELTKYLGNELGLVNPDVRIAKILMQSLFKRNGYFVYLTGRSGNQLILQNAVNLVLAYDEISYIHKLEKYSLSSIADDLTSEKNVGLYDVLSNKFNGSIFKDRPNPVGKLLISGRDKFLDLNLEEQCYVLIQILNLSKIGVAKADLKLIGGSSQSGMMKMSKTLKPDDRMELIYQSVSGIFEKRVDLLKV

SEQ ID NO: 3160 - protein, 1358 aa, Unknown
  Description of Unknown: uncultivated organism sequence
  Category: MG91 effectors
  Description: MG91-352 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIHKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYVQLCLNGKWVDYIHKLEKYQDKGFIDNVITDEKNVELYNVLCEKHNVGIYTMRPNPVGDRIKNGYDKFVNLTTEEQIKLLIEIIKLTCVGIVSADLTLIGGAAISGKMLMSKNITDANECILINQSVTGLYENRIDLLRV

SEQ ID NO: 3161 - protein, 1358 aa, Unknown
  Description of Unknown: uncultivated organism sequence
  Category: MG91 effectors
  Description: MG91-353 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDANYYKQYPTIFHLRKELIEDVSQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHVSELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSGFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYVQLCLNGKWVDYIHKLEKYQDKGFIDNVITDEKNVELYNVLCEKHNVGIYTMRPNPVGDRIKNGYDKFVNLTIEEQIKLLIEIIKLTCVGIVSADLTLIGGASISGKMLISKNITDAKECLLINQSVTGLYENRIDLLRV

SEQ ID NO: 3162 - protein, 1358 aa, Unknown
  Description of Unknown: uncultivated organism sequence
  Category: MG91 effectors
  Description: MG91-354 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILKLFSFQIPYYVGPVSSNSNGWVKRLESGQVLPWNIDKKIDLKETSEQFIQRMVRNCTYIAGEKVLPKASLLYENFKVLNEINNLSINDERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYVQLCLNGKWVDYIHKLEKYQDKGFIDNVITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3163 - protein, 1358 aa, Unknown
  Description of Unknown: uncultivated organism sequence
  Category: MG91 effectors
  Description: MG91-355 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFYVEDKQDNVKDKNGIFNDKNYKDANYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3164 - protein, 1352 aa, Unknown
  Description of Unknown: uncultivated organism sequence
  Category: MG91 effectors
  Description: MG91-356 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCKEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3165 - protein, 1358 aa, Unknown
  Description of Unknown: uncultivated organism sequence
  Category: MG91 effectors
  Description: MG91-357 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIRSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGAAISGKMLISKNITDAKECLLINQSVTGLYENRIDLLRV

SEQ ID NO: 3166 - protein, 1358 aa, Unknown
  Description of Unknown: uncultivated organism sequence
  Category: MG91 effectors
  Description: MG91-358 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKTANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3167 - protein, 1358 aa, Unknown
  Description of Unknown: uncultivated organism sequence
  Category: MG91 effectors
  Description: MG91-359 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMIWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3168 - protein, 1358 aa, Unknown
  Description of Unknown: uncultivated organism sequence
  Category: MG91 effectors
  Description: MG91-360 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3169 - protein, 1358 aa, Unknown
  Description of Unknown: uncultivated organism sequence
  Category: MG91 effectors
  Description: MG91-361 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDAFQKDVRLVYLAVANMFKHRGHFLLSGIGSESSKQTITDLYNQVSGLITEEYGISLKTDIAGTDFEQVLCSREYSRTRKLEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNVLCEKHNVGIYTMRPNPVGDRIKNGYDKFVNLTTEEQIKLLIEIIKLTCVGIVSADLTLIGGAAISGKMLMSKNITDANECILINQSVTGLYENRIDLLRV

SEQ ID NO: 3170 - protein, 1358 aa, Unknown
  Description of Unknown: uncultivated organism sequence
  Category: MG91 effectors
  Description: MG91-362 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFYVEDKQDNVKDKNGIFNDKNYKDANYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWGKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3171 - protein, 1358 aa, Unknown
  Description of Unknown: uncultivated organism sequence
  Category: MG91 effectors
  Description: MG91-363 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSISGERIAVALKQDLYNTLFLKGKRVTRKQIFNYFHSRGLVEEDSQISGIDIAVNNSLSTYGKFLPLFGDHLKEDKYKKMVDDIVFWCTVYDDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPKEGETGTLATVKKMLSRNTPILTRLAIEGHGGIVDATRYSHKKVKQDTYIPLKSSDARMADVTKYGGYSDVKIAYLFLVEHETKGKKIRTLETVPIYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3172 - protein, 1358 aa, Unknown
  Description of Unknown: uncultivated organism sequence
  Category: MG91 effectors
  Description: MG91-364 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAHVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIHKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYVQLCLNGKWVDYIHKLEKYQDKGFIDNVITDEKNVELYNVLCEKHNVGIYTMRPNPVGDRIKNGYDKFVNLTTEEQIKLLIEIIKLTCVGIVSADLTLIGGAAISGKMLMSKNITDANECILINQSVTGLYENRIDLLRV

SEQ ID NO: 3173 - protein, 1358 aa, Unknown
  Description of Unknown: uncultivated organism sequence
  Category: MG91 effectors
  Description: MG91-365 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAHVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKTANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGFIDNVITDEKNVELYNVLCEKHNVGIYTMRPNPVGDKIKKGYDKFVNLTTEEQIKLLIEIIKLTCVGIVSANLTLIGGAAISGKMLISKNITDAKECLLINQSVTGLYENRIDLLRV

SEQ ID NO: 3174 - protein, 1352 aa, Unknown
  Description of Unknown: uncultivated organism sequence
  Category: MG91 effectors
  Description: MG91-366 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPSSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3175 - protein, 1353 aa, Unknown
  Description of Unknown: uncultivated organism sequence
  Category: MG91 effectors
  Description: MG91-367 effector
MEKDYYLGLDMGTDSVGWAVTDENYNLIRAKGKDLWGVREFESAKPAADRRSYRISRRRRQREQVRLGMLKSIFADAIKEKDPLFFIRLENSKYWKDDKNSKINTKNVLFDDPGYTDADYFKEFPTIFHLRLKLMNDDSGRYLSDPRFVYLACLQLFKHRGHFLSDISDETDPSDLSSTYERFKSLYCELTGYEFTEKDVAADDIMNVLSDRNLSRTAKKEKLIDVFSFSKSDSSKTECLKSICGLESDACKIFPDLKTEDIKKLSFNFSKSDYEEKSAELNESVGDEYFELISILKDIYDKGTLADILKGKKYLSEARVEDYNKHKKDLVLLKSVYRKYKTQDEYNEMFRDPTKGYGAYIGSNFTKDKKTSRRGSKSRDVFYDYLKKSLKGLEEDPDVKTIFDDIAKENFLVKQLTSSNGVIPNQVHLKELKKILSNAENYLPFLKETDESGLSASQRIISIFSFTIPYYVGPVSELSEKNGGNGWVVRKEDGKVYPWNFEDKINISETKRRFIDRLINECTYISGEKVLPKQSLIYQKFAMLNELNSVRINGERLDVEFKQKAFKELFSKGKQVTLNEFKNYLNNNGINIDEKSEISGVGKSSEMTRFNNKLSSYQVFHSVFGDKLEDKKYYDAAENIIYLGTIYADDKKTFKKAIEEKYGDFLTPDEIKRVSGLKFKDWGTLSAALFNLQGAEKSTGEVMTLIDALWNTQLNFMELINSDAFSYKEELEKYKKKGEGTIQNFKFEELNDYYFSAPVKRMIWQTVLIVREIEHVLGKPPVKMFVEVTRHDEEKEKIPPSRKDTFLSLYKNIKDESHDWKAIIEKADESGVIRSQKMYLYLSQMGRDLYTGKEIELDELFTTKYDIDHIIPQSLKKDDSILNNKVLTSKDFNNNIKQDNPLCEAIDDAHYAERKKLWDRLHNYNLINDEKYKRLTNRKGFSEEDLEGFIARQIVETSQAVLGVINIFKEIMPDTKIVFSKAKPVSDFRKNEIGWLKSRTLNDYHHAHDAYLNIVVGNVYNTKFTDNPRNFIKKERQKDLNPNYHMNKVFWYNVERGGKVAWIAGEDGTKKTVLKTLAKNSELMTRQSFEQTGGLCNQQITNKDDAGSGIGYLPVKMGEDISKYGGYAKISQSYFFLVEHTFKKKRIRTIETVPAYLKSQIESDPDALKRYCAEKLGLVDPDIRLRRINYQSLAKYNGFYVTICSKTGVRFNIANAVRLTLPKEWNNYIKKLEKTEGDEEITEEKNIELYDILTDKHLNSIFLKRPNPVGENLKNGREKFVSLSKKEQVSTLNNILLFTGFASAGKADISSIGGSKNAGFMKISKNVTNADEFVLIENSVTGIYSVRKDLKTI

SEQ ID NO: 3176 - protein, 1352 aa, Unknown
  Description of Unknown: uncultivated organism sequence
  Category: MG91 effectors
  Description: MG91-368 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSSEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDTYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLTSNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3177 - protein, 1353 aa, Unknown
  Description of Unknown: uncultivated organism sequence
  Category: MG91 effectors
  Description: MG91-369 effector
MEQKTYYLGLDMGTNSVGWAVTDENYNLLRAKGKDLWGIREFESASGAIERRAHRVSRRNRQRQQVRVGKLNCYFEDAINEVDPNFYARLRNSKYHLEDKEEAVRTPNGIFNDPAYKDKDYYAQYPTIYHLRKELLTNDEPHDVRLVYLALLNMFKHRGHFLNAALTSEGTRHMQDAYNSFQENVYEMCDLSFPDVDGKEIEAVLSNRDLNRSRKSEALMELFHFTKKENKTELEFVKGMCGLTTEASKLFGDLGLEEKVEICFSKASYEDRIPDIMDAVGEENFRVLENLKEIADIGTLAGVLKGYTYLSEARVAEYEKHKSDLKLLKSVIRQYGTQEDYNKMFRSEESGTYSAYVNSYNSGKKQRRDMKGRTREDFYKSLKKLLKGMPEEDENVAQILAEIDKEKFLPKQLTASNGVIPNQVHLKEMKAILRNAEQYLPFLKEVDESGLTTSERIWRLFSFQIPYYVGPVTPNSSRDGGNGWVVRKEEGEVLPWNINEKIDLPATQDAFIKRLVRECTYISGEKVLPKGALIYEKFAVLNEINNIRIDNERLDTPLKQAIYNDLFCTGKRITRKKILDYLSAQGKLKNESQLTGIDKNINNSLSSYGKFLGVFGEDLKKDHYIDMSEDIIYWCTVYGDSKKVLRSLLEEKYQGELTEKQMKRILGFKFGDWGRMSREFLELEGIDKETGEVVTLIHAMWDNSMNMMELIHSDRFTFAESLESKKTKMDKTLSEFKHEDLDEYYFSAPVKRMIWQTLLVIKELEKVLGGPPTRLFVEMTRSDDVKGDKGRKKSRKDELLELYKKVKDESHDWTAIINAADENGTIRSKKMYLYLTQRGRCMYTGKPIDLNQLFDNNIYDIDHIYPRHFVKDDNLRNNLVLVDKRANARKSDNYPIDSNIRCNDSIKALWYSLKKEKLISEEKYRRLTGSNPFSDEQKAGFIARQMVETSQATKGVNDLLKQLLPETELVYSKASNVSDFRRDYDLLKSRTINDFHHANDAYLNIVVGNVFLVKFTNNPRNFIKEYNRDKYTYGYNLGRIFERDVKRGDQVAWIADDRNGNHGTIETVKKMMAKHTPLLTRMNFVNNGQISKGTLYSKFKAKPDTYIPLKETDEKMRDISKYGGFTNVSTAYFFLVEHGKANKRIRTIEAVPIYMKSRLENNEEELKKYCVEQLGLLDPSIRLNKIKIQSQFRINGFYVFFRGKTGHELLWGNNTSLCLEPKWNNYISYLDKYAKNGYMNRFITKEENEHLYSELLKKHSEAIFSKRPNSFSKIVIAGQEKFKDLDIEKQCVALSQLISATSIGSSIADVTMIGGTAQTGRMRTNKKISGYELVLINTSATGLYKTEIDLNKI

SEQ ID NO: 3178 - protein, 1123 aa, Unknown
  Description of Unknown: uncultivated organism sequence
  Category: MG91 effectors
  Description: MG91-370 effector
MSKKILSLDLGITSIGYSVLDEMQNDRYRLLDYGVSMFDKATDKDGNSKKLLHSINSSTANLYALRKKRKQNLASLFEAFGLGEKTTLLQQEKNNLYKNKWQLRAKKAFEEKLEVGELFTIFYALAKHRGYKSLESGDLLEELCEKLGIEVQSASKQKKDDDEKGKIKKALKTIENFRVENPEKTVAQIIYEAEIKKENPTFRNHDNYNYMIRREYINDEIGKIIKMQENFGFFECSFDVDLFITKLIATIDDQKDSTNDLNFFGNCQYYDDEKAAHQYSLLSDIFKMYESVANITFNAKPVVKITKEQIQLITDDFFKKIVKGKNVTEIKYKDIRKILQLSDDMKIFNKEDSRIIKGKKSDNTIIKFHFLNNLSKINNNFITKALEQENKYEILKEIFDVLAYEKAPHTIFENLKNKIEDEQTIIDLIRYKSGNSMNISHYAMMQFIPYFEEGFTTDAIKEKLGLDRQEDYSKFKKGIKYLHVNNFEKDDKLEINNHPVKSVVSATMRVVKHLHATHGAFDEIRVESTRELSQNEETKKEIEKANKALQKEIDTIVNNKEYQEIAKSYGKNLKKYARKILMYLAQEGRDIYSGKGIEIADIFTNSVDLDHIVPKSLGGLSVKHNLVLAHRNTNVQKSNQLPLNFVADKQAFINRVEYLFSEHKINWKKRKNLLATNLDETFQDIFESKSLRATSYIEALTAQMLKRYYPFANEKKRVDGSAVRHIQGRATSNIRKLLHVKIKVRDTNIHHAIDAILIGLTNQSWLQKLSNTFRENMGIIDDEARAKIKKEIPLIEGIEPQELIEMIEDRYNVFGEESVFYKDIWGKTKVINFWISKKPMVSKIHKDTIYAKKPNGFYTVRESIINKFGGLKITPKTSSEEFIKIFKKNILHKMYLYKTNPKDTMCQIIQKRGEAIATLLDSFTDFDSKNKEQMSEAKMALDSLIHSDLVDNNGNIVRKVKFYQTNLTGFDVRGGLATKEKTFIGFQSWLENEKLHYKRIDVANFKKIKKQNDGNFQVFKNDIVFFVYPNGSFRGGKIVSFLEENKTGAFQNSKFPMSLKYQPEIFCELNKEKKHVKTKPRSIGKSTGIIKLNLDIIGNIKSYTCIGKIESEILDFIKASVNG

SEQ ID NO: 3179 - protein, 1342 aa, Unknown
  Description of Unknown: uncultivated organism sequence
  Category: MG91 effectors
  Description: MG91-371 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEKLENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQHQFDFLFRGTEKGSYSAYVHSVNSHEKQRRNMDGNKKEDLYSTLKKILKDMPENEEKTYIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEEFISRMVRRCTYMNDEQVLPKESLEYESFCVLNELNNIKVYGEKLPVDIKQDIYRTLCEKGKRITKKSLMKYLVGRGVIKAEDEAQLTGLMDGLNNTLKSFAKFKAIFGDAIYEDSCKKMVEQIIFWCTVYGDSKHFLKEQLLEKYGEVLTDAQIKRILGIKFRDWGNLSKKFLELQGCSKETGEVNSLIRMLWETNDNLMELLAQDSYTFKEELENMQESTYKVLTELQLEDLDHMYFSAPVKRMIWQTILIIKEVTKVMGCQPERLFIEMTREHGQKNDIKDSRAKKFYELYSKIKDEDKDWRKVIEDADKDGKIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSDFRKDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLEVLKLSNPDIRVRKILIQSLIKRNGYYMQITGKTGNRMYVRNMVSLCLVQDWVNYIKKLEKDKDENISKEKNIRLYDVLMDKHINTIYNTRPNPVGDLLIKRRSDFIELKITDQVIILLEILKLTQTALGSANLKLIGEAEKTGVMLISKDITALDEMLLINQSVTGLYEQRVNLLTV

SEQ ID NO: 3180 - protein, 1358 aa, Unknown
  Description of Unknown: uncultivated organism sequence
  Category: MG91 effectors
  Description: MG91-372 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSISGERIAVALKQDLYNTLFLKGKRVTRKQIFNYFHSRGLVEEDSQISGIDIAVNNSLSTYGKFLPLFGDHLKEDKYKKMVDDIVFWCTVYGDSRKFLREQLEEKYSDVLDENQIKRITGMKFKDWGNLSKEFLELSGCCKSTGEMMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGPGGIADATLYSHKKAKQDAYIPLKSSDARMADVTKYGGYSSVTTAYLFLVEHEIKGKKIRTLETVPLYLKDRLENSKEKLEEYCGETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3181 - protein, 1352 aa, Unknown
  Description of Unknown: uncultivated organism sequence
  Category: MG91 effectors
  Description: MG91-373 effector
MTAFKYYLGLDMGTNSVGWAATDPGYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLQDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLENETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3182 - protein, 1352 aa, Unknown
  Description of Unknown: uncultivated organism sequence
  Category: MG91 effectors
  Description: MG91-374 effector
MTAFKYYLGLDMGTNSVGWAATDPGYRLLKAKGKDLWGIREFNEASGAVERRTHRISRRRRQREQVRIGILKDYFHDAICEVDPGFFQRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCSKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3183 - protein, 1358 aa, Unknown
  Description of Unknown: uncultivated organism sequence
  Category: MG91 effectors
  Description: MG91-375 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3184 - protein, 1358 aa, Unknown
  Description of Unknown: uncultivated organism sequence
  Category: MG91 effectors
  Description: MG91-376 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITYANECILINQSVTGLYENRIDLLGV

SEQ ID NO: 3185 - protein, 1358 aa, Unknown
  Description of Unknown: uncultivated organism sequence
  Category: MG91 effectors
  Description: MG91-377 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKDSLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDILENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3186 - protein, 1358 aa, Unknown
  Description of Unknown: uncultivated organism sequence
  Category: MG91 effectors
  Description: MG91-378 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCHPTRIFIEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLFDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3187 - protein, 1358 aa, Unknown
  Description of Unknown: uncultivated organism sequence
  Category: MG91 effectors
  Description: MG91-379 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDIVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKYIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFFELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNASDFRKKYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGAAISGKMLISKNITDAKECLLINQSVTGLYENRIDLLRV

SEQ ID NO: 3188 - protein, 1352 aa, Unknown
  Description of Unknown: uncultivated organism sequence
  Category: MG91 effectors
  Description: MG91-380 effector
MTAFKYYLGLDMGTNSVGWAATDPGYRLLKAKGKDLWGIREFNEASGAVERRTHRISRRRRQREQVRIGILKDYFHDAICEVDPGFFRRLENSKYHEEDKDVEVRYKNNIFNDSNYTDKDYFNEYPTIYHLRNELISSTEKHDVRLVFLALLNMFKHRGHFLNAGLGENNGESNIDNVYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3189 - protein, 1358 aa, Unknown
  Description of Unknown: uncultivated organism sequence
  Category: MG91 effectors
  Description: MG91-381 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQVKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCHPTRIFIEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3190 - protein, 1022 aa, Unknown
  Description of Unknown: uncultivated organism sequence
  Category: MG91 effectors
  Description: MG91-382 effector
MKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIDDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNREFPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3191 - protein, 1342 aa, Unknown
  Description of Unknown: uncultivated organism sequence
  Category: MG91 effectors
  Description: MG91-383 effector
MRYFMGLDMGTSSVGWAVTDEHYQLLRRKGKDMWGIREFEEAATAVERRTHRVSRRRRQRQVARIGLLQEYFHDAIHQVDPNFYQRLKNSKYHEEDKDEIVRESNGIFNDAEYTDKEYFKEFPTIFHLRQELIKSKEPHDVRLVYLALLNMFKHRGHFLNATLSADGESRKIKDIYTDFVDKAAEQLGVSFATDIRYEELENYLSSNDLSRKRKGELIAELLHVTRKDKQQYALIECMLGLDKSVKLMFGDTLPEDFDKTIKVNFSDIAFEEKATEISEAIGEEKYDLILIMKEIYDAAILNRIMNGYTYLSDARVAEYEKHKSDLACLKHYIKEYGTQQQFDFLFRGTEKGSYSAYVHSVNSHEKQRRNMAGNKKEDLYSALKKMLKDMPENEEKTCIMMQIELDNFLPKQLTASNGVIPNQIHLKEMKKILANAENYLPFLKEKDESGYTVSERIQKLFAFQIPYYIGPTTEKSAEFGGNGWVVRKEEGKVLPWNIDQKIDMKKTSEKFISRMVRRCTYMNDEQVLPKESLEYESFCVLNELNNIKVYGEKLPVDIKQDIYRTLCEKGKRVTKKSLMQYLVGRGVIKAEDEEQLTGLMDGLNNTLKSFAKFKAIFGDAIYEDSCKKMVEQIIFWCTVYGDSKHFLKEQLLEKYGEVLTGAQIKRILGIKFRDWGNLSKKFLELQGCSKETGEVNSLIRMLWETNDNLMELLAQDSYTFKEELENMQESTYKVLTELQPEDLDHMYFSAPVKRMIWQTILIIKEVTKVMGCQPERLFIEMTREHGQKNDIKDSRAKKFYELYSKIKDEDKDWRKVIEDADKDGRIRSKKMYLYLTQMGRCMYTGRPIDLDQLFNNNLYDIDHIYPRHYVKDDNLENNMVLVEKQSNAHKSDVYPLESGIYEKQVNWWRELHRKNLINDEKLKRLTGRNPFTDEQKAGFIARQLVETSQGTKGVATILQEALPDTTLVYAKARNVSEFRSDNDLLKSRIVNDFHHAHDAYLNIVIGNVYYVKFTKNPINFIREHGTYNLGKMFAKDVKRGDDIGWVAQSGNGQTATMETIKRTMARNTPLLTRMSYEVTGGLANQTLYSASKAKEGTYIPLKSSDERMQDVTKYGGFTSVSTAYFMLVEHDGKKGKRIRTIESVPIMWKERIEKNPAELERYCLDVLKLSNPDIRVRKILIQSLIKRNGYYMQITGKTGNRMYVRNMVSLCLVQDWVNYIKKLEKDKDENISKEKNIRLYDVLMDKHINTIYNTRPNPVGDLLIKRRSDFIELKITDQVIILLEILKLTQTALGSANLKLIGEAEKTGVMLISKDITALDEMLLINQSVTGLYEQRVNLLTV

SEQ ID NO: 3192 - protein, 1299 aa, Unknown
  Description of Unknown: uncultivated organism sequence
  Category: MG91 effectors
  Description: MG91-384 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRI

SEQ ID NO: 3193 - protein, 1352 aa, Unknown
  Description of Unknown: uncultivated organism sequence
  Category: MG91 effectors
  Description: MG91-385 effector
MTAFKYYLGLDMGTNSVGWAATDPGYRLLKAKGKDLWGIREFNEASGAVERRTHRISRRRRQREQVRIGILKDYFHDAICEVDPGFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCSKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIISALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3194 - protein, 1138 aa, Unknown
  Description of Unknown: uncultivated organism sequence
  Category: MG91 effectors
  Description: MG91-386 effector
MVKYKIENLERKMSKKILSLDLGITSVGYSVLEELEKDKYSLIDYGVSMFDKPIDKDGKSKKLLHSSIKSTTKLYNLRKQRVKKLAHLFEKYNLGLATELLNQEKENRYPNKWRLRAKKVFEQKLTVGELFTILYLIAKHRGYKSLDSDDLLEELLLELGFEIEEKKSKKDDEKGKIKKALKTIEELIVKNPHKTVAQIIYEEEIIKDNPTFRNHDNYNYMIRRQHIKEEIEKIVVAQYEFGLFENDFEVKSFIKELIESIDDQKDSSNDLSLFGNCQYYPEFKVAHQYSLLSDIFKMYESVSNITLNKTKITKEQIEMVANWFFKKIEQGKNFSEIKYQDIRVVLKLSDEVKIFGKEDYYLDKKGKRVHHTITKFHFLSSLGKIDNGFIKVLFQKANSLEILDEIFDILKTEKSPKTIYSKLTDTFLRYDLIEDKKIRDETVINLIKNKSGKSLNISAYAMRKFIPYFKDGLSTDEIKEKLNLNRDENYANFKKWIKYLHIKNYEKDDNLEINNHPVKYVVSATIRVIKHLHSTYGVFDEIRVESTRELSQNEETKKAIEKANKENEKKFKEILENKEYQKIASDYGKNLKKYARKIILWEEQDKLDIYSGKVIDFDDIFSNRVDIDHIIPQSLGGLSVKHNLVLAHRDENVKKSNQLPMNFIKNKDDFVKRVEYLFSEHKINWKKRKNLLATTLDEAYQDTFESKSLRATSYIEALTAQMLKRYYPFPSKNKQRDGSAVRHIQGRATSNIRKLLGIKSKVRNTNIHHAIDAILIGLTNHSWLQKLSNTFRENIGVIDDEARAKIKKQIPIIEGIEPKELVELIESVYNIYGEESIFYKDIFGNTKSINFWVSKKPMSSKIHKDTIYAKKPNGIFTVREDIIKQFVGLKVTVKTEPKKFIESFEKKIANKIYVCKINPKDIICQIIKERAKEIELLLKSFVTLNHKDKEQISQAKEKLDTLIHKPLIDNNGNIIRKVKFYQTNLTGFDIRGGLAVTEKTFIGFKAIKGDKKIEYKRVDASNFQKIKKENDGSFKVYKNDIVFFIFSDATYKGGRVVSFLEDKKIVAFSNPRFAPNAKSQPISFVTIFKGEPYSHKQHSINKAIGIIKINLDILGNIKSYQKFGEVSKEIEAKILHME

SEQ ID NO: 3195 - protein, 623 aa, Unknown
  Description of Unknown: uncultivated organism sequence
  Category: MG91 effectors
  Description: MG91-387 effector
MYICSRLHSYTIVSETFVLTLPLKVEKWQADILDKRYELLRHTYNMVQQKLLRQYIYFSQQKAFKACKNFQQKREFFVSHPFHFRGINGKNGEPSDIKFPYTFESRSSNSGKRPSGGISDYVSKLWSHRIGQDKTLSNLGINSYILEELGLHIMKAWETRLYVPKSSRISFREFGDINSFGSRYKKGNFAGFTINLEEGFITYNTNGRKGEKANLVKLPIDFSREKKSYAVEALKGGKDSIRKLLIVRRQIRGRNKYYLQFTINGEKPQKGRTLGIGNVGIDIGPSTIATSSLQGVHFDKLADKCDNIEHELYLVNRKLDRSRRANNPQNYNADGTIKRGVRLVWKKDKEVKRYATLKMLRRELYRKQAEIRKQQHLEMANTMLSQGDTFIVENNPIDAWVRRAKDTTKTKTGRNRCKKRYGKSVANHAPAMFVSLLKNKVLSLGGHFYEVDTRYAATQFDFINGVRTKHEVSERSITLSNGRTHHRDMLSAFNLQHIKLESIGTEDRDYDIKQMEADYPIFCKLETTEQERFKEARRNERDALYFVGAAEKQLRRKPQEETVANRHNGGVGRKHCNTRLGSSIKENAKITGSGLVRESIERISQVPNEYHHAGSHPIILDGL

SEQ ID NO: 3196 - protein, 1352 aa, Unknown
  Description of Unknown: uncultivated organism sequence
  Category: MG91 effectors
  Description: MG91-388 effector
MTAFKYYLGLDMGTNSVGWAATDPGYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTKVTGAYFFLVEHTEKKKRIRTIESVPVSFVQKIEKNLGELKKYCEEILGLVDADIRLKKIKIGSLIKRNGYFCYITGKTGNRLSVRNAVNLCLKNEWIKYISKLEKVKEKDTIDEIITKEKNEVLYSELIQKFKHCIFSKRPNPVGDKLEKGSEKFSNLSIKDQCAVLCQVLRMAAILGSECDMTLLGESSICGEMKISKKIGDEEIYLINQSVTGLYEKKINLHTV

SEQ ID NO: 3197 - protein, 1293 aa, Unknown
  Description of Unknown: uncultivated organism sequence
  Category: MG91 effectors
  Description: MG91-389 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFYVEDKQDNVKDKNGIFNDKNYKDANYYKQYPTIFHLRKELIEDASQKDVRLVYLAVANMFKHRGHFLLSGMGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYEKVLSVLYSH

SEQ ID NO: 3198 - protein, 1357 aa, Unknown
  Description of Unknown: uncultivated organism sequence
  Category: MG91 effectors
  Description: MG91-390 effector
MQGYYLGLDMGTNSVGWAVTDYEYRLLRFKGKDMWGIREFDEAKPAVERRRHRTNRRRQQRKMVRLGLIKSYFADEISKIDPLFFNRLDNSKYFLEDKDEQVRCKNAIFNDINYTDKDYYAQYPTVFHLRKELIENKEPHDVRLVYLAISNMFKHRGNFLISGLGIDRDDETIGEAYLKVADMLSEEFDVEFDKKIDLSFFEKTLSSREYSRTKKSELICDILQVKNSEKQKKAFVKCLCGLNVKISDIIGENGIELSDEDKKTAFSFNDNDYDVKIIEIEQKIGENKTTVIAKLKEIHDKALLSEIMKGKPYLSYARVADYEKHAYDLKILKRVIKKYFSNQEYDNLFRSEENGTYSAYVNSYNSGNKSRRNYKERKQEDLYKNIKSLMKSLGDNDDIDVQYIKDEIDRENFLPKQLTFKNGVIPNQVHANELKAILNNAQEYLTFLNEKDESGYTVSERIQQLFSFQIPYYVGPVSSDSNGWVVRKEEGPVLPWNIKEKIDLKKTSEEFIGRMVRNCTYISGERVLPKASLLYEKYRVLNEINNLRIDGERISVELKQDIFNTLFLKGKRVTRKQIFNYLHSRGMAQEDAQISGIDVTVNNSLSTYGKFLPIFGEHLKEDSYKKMAENIVFWCTVYGDSKKFLKEQLEEKYADKLDEAQIKRILGMKFNDWGNLSKEFFELSGCNKSTGEVMPLINALWENNLNMIELLNSDEFTYKESLAEKQNVAIKSLSEYTIDDLNEEYFSAPVKRMIWQTLMIIKEIEKIMKASPDRVFIEMTRKDGEKGDKGRKNSRKDKLIALYKQIRSEDSAWKKEMSSRIEKYDENGSLRSKKLYLYFTQKGLDMYTGKPIDIDDLMSANSKYDIDHIYPRHFVKDDNINNNLVLASKTANSEKSDIYPIKDTIYQKMKSTWKLLKDENLITEEKYRRLVGREPFTDEQKAGFIARQLVETSQGTKGVADLLNMLLPDSKIVYSKADNVSEFRHKYEIPKSRLINDYHHANDAYLNIVVGNVYYTKFTQNPINFIKKEYSSGDRKFEYNLSKMFEWDVVRGDKVAWVAEKDRKHGTIVTVKKMINKNTPILTRMPVEGHGGLADATLYSHKKAKSDTYIPLKATDAKLQDVTKYGGFSSVATAYIFLVEHELKGKKVRTLETVPLYMKAELESSVERLEQYCRDTLGLINPSVRIKKIKLQSLIKLNGYYMQISGKTDKQFGMRNCVQLCLKKEWIEYVHKLEKFQSYGVIDDIISEQNNIKLYDELCEKHRNGIYNKKPNYMGDKLLNGKNEFVKLNKNEQIKVLIQIIKLTVVGLVEGDLTLIKESSKSGTLKISKNITNAKEFELINQSITGLYENRIDLLRV

SEQ ID NO: 3199 - protein, 1343 aa, Unknown
  Description of Unknown: uncultivated organism sequence
  Category: MG91 effectors
  Description: MG91-391 effector
MEYYMGLDMGTSSVGWAVTDEKYNLIKKHGKDMWGIREFEEADTAEARRTFRVARRRRQREVVRIGLLKEYFHDEVIKVDPNFFQRLENSKYFQEDKDEEVNEKYGIFADKNYTDKDYFKKYPTIYHLRKELLHSQEPHDVRLIYLALLNMYKHRGHFLNASLGIDGENRKMKDIYCDFVLMARDVLELEFPTEFGEVQFQNLMCARDLSRKKKAEKLIDLLGIDKKQKQHIALLECILGLDKSVKTLYGKKLADDFDKSIKINFSDSGFDEKAEELADILGEERFDLILCMKELYDSATLNQIMGTHKYLSEARVQEYEKHKNDLKKLKCVIKKYGTREQYAFLFRSVEKATYSAYVRSVNSGGKERRNMSERTKDALYATLKKILKEFPADDKDCIYIMEEIEKNHFLPKQMTSANGVIPNQIHAKEMKQILKNAEKYLSFLSEKDESGLSVSERILQLFTFQIPYYIGPLSTNSAKNNGNGWVIRKEEGKVFPWNMDQKIDKKKTSEEFISRMVRRCTYMGGEQVLPKSSLEYECFSVLNELNNLKVRNEKLPVEIKQKIYTDLFTRGKKVSKKSIANYLKGCGILQEGAEDELTGMMDSINSSLSSYGKFRAIFGDQMKEDSCKKMIEKIIFWCTVYGNSKQFLKEQMEENYGSILTQNQIKRILGFKLKDWGNLSKEFLELQGSRKDTGEKMSLIRMLWETNDNLMELLDNSQYTYKKELEKRQENLEKTLKEIQPEDLEGYYFSAPVKRMIWQTLLVLKETEKVMGQPPKRLFVEMTREHGEKNDIKDSRAKKFLDLYKNIREEDHDWKNVIENAEESGTIRSKKMYLYLTQRGRCMYTGNIIDLSQLFDNNLYDIDHIYPRHFVKDDNLENNMVLVEKQKNAHKSDKYPLEESIYNKQISFWRELHHQKLINDEKFKRLTDRNPFSDEQKAGFIARQLVETSQGTKGITKILKEVLPDTTMVYAKAKNVSDFRNQYKILKSRVVNEFHHAHDAYLNIVVGNVYYTKFTNNPINFIKKQEPYNLSRVFEWNVVRNGEEAWIAKPEKEQKITIETVRKMLARNTPLLTRLSFEGTGGLANQTLYGAEKAQGDGYIPLKSSDLKLRNVRKYGGFSSVSTAYFILVEHEQKKKRVRTLETVPILWKDRIEKDPKQLEVYCTEVLGLINSDIRIRKIRIQSLVKKDGYYMYLSGKTGNQIIMRNAVQLCLRQEWINYIKKLEKETIDEVITKEENSELYNLLCEKHLEGIYAKRPNPVGEKLRKRICEFNQLEITEQRQLLLELLNLSKIGVVKANLTLIGETSSAGTMKVSKNISESKEFKLIHQSITGLYEKQVDLLNV

SEQ ID NO: 3200 - protein, 1347 aa, Unknown
  Description of Unknown: uncultivated organism sequence
  Category: MG91 effectors
  Description: MG91-392 effector
MEEKEYYLGLDMGTNSVGWAVTDPQYIILRAKGKDMWGIREFESAETAETRRVHRTSRRRRQREVVRMGLVKDYFSDAINNVDGNFYARLENSKYHLEDKDETVRNKNGIFADEHYTDKEYYAEYPTIYHLIMELINNPAPHDVRLVYLAVANLFKRRGHFLNAGLSEDGGNQSMQTAYDEFNTTCNETLEFSFPGIDATQIEEVLKNRNYSKTVKSEKLAELLGVEKKEKQRIEILRAIAGRKVNAKVIFPNVETEDKVEFSFSDAAFDDNATELMTLLGDECYSLVLCMREMYDIGTLAEIMHGYQYLSESRMADYQKHHEDLVLLKSVIKSECTQKQYDELFRLDGEGSYSAYVNSILAKNHKQRRSMKGRTRDDFYKKVREFIGKSSNPDAIKICTEIENETFMPKMLTSANGIIPNQVHYKELKAILSNAEKYLPFLLEKDESGLTTSDRIQRLYKFRIPYYVGPVSNRDGKGNGWAVRKEEGMVLPWNLEEKIDLSKTKEAFIENLIRRCTYISDEKVLPKNSLIYEKFTVLNEINNIRINDERISVELKQDIYNDLFKKGKKVTRKTLAKYLINRGAIKAENQISGIDIAINNSLSSYGKFKAVFGESMDTDSTKKMVEDIIKTSTIYGDDKRELKNILRDKYGEILSEDQIKRIAGFRCKDWGRLSRAFLELAGTNCGTGEVTSIIQALWESQLNLMELLHSEDYTFGESLNEKLVKNEKSLSEITAEDLDDYYFSAPVKRMAWQTILLIKEISKIKGCEPSKIFIEMTRTDEEKGDKGRKNSRAKELTALYKNIKKEGKAWIELISKEDASGRLKSKKMYLYIKQMGRDMYTGEQIDLDRLFDDNLYDIDHIYPRHFVKDNNIENNLVLVNKAKNSRKSDNYPLDSDIVRNPKVRELWEMLHTNHLMSDEKYHRLTSRKAFTDEDMAGFIARQLVETGQATKGVADLLKDLTNSEIIYSKAGNVSDFRHTYDIPKSRIVNEFHHAHDAYLNIVVGNAYYTKFTSNPLNYIRKEYKKNTKENNYHLNKIFASTISRNGYVAWFAGSDKNPGTIQTVKKMLSRNTPLMTRMTFVVHGSIAEETLYGKNTAKEDSYLPLKGSDPRMSVEKYGGFKKASGAYFFLVEHELKGKKVRTIETVPVYLMKKLSDKRELQKYCEEKLGLINPSIRLKQIKMQSLIKLNGYFVNVTGRTNKQLTLRNAVNLKLDKEDIYIIHLVEKCIGEERDDRLSEESILSLYQTLTEKQVSGIYRNRPNSVYEKLNEGMIRFKKLERKQQIKVLANMLNLTMVGKAQADLKDIGGSANSGVMLMAKKINNYNEVKLINQSVTGLYQTEVDLLTV

SEQ ID NO: 3201 - protein, 1352 aa, Unknown
  Description of Unknown: uncultivated organism sequence
  Category: MG91 effectors
  Description: MG91-393 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSEFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCEEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCAVLCQILQLAAVLGSECDMTLLGESAHCGKMLISKKIGDEEIYLLNQSVTGLYEKKINLHTV

SEQ ID NO: 3202 - protein, 1358 aa, Unknown
  Description of Unknown: uncultivated organism sequence
  Category: MG91 effectors
  Description: MG91-394 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRESLGYTNPSVRMKKIKLQSLIKLNGYYMQISGKSIKQFEVRNYVQICLNGKWVDYIHKLEKYQDKGVIDNAITDEKNVELYNILCEKHSVGIFTLRPNPVGDKIKKGYDKFVNLTTEEQIKLLIEIIKLTCVGIVKADLRLIGASEKSGTMKINKNITDAKECFLINQSVTGLYENRIDLLRV

SEQ ID NO: 3203 - protein, 1215 aa, Unknown
  Description of Unknown: uncultivated organism sequence
  Category: MG91 effectors
  Description: MG91-395 effector
MYNRYYLGLDMGTSTVGWAVTDPDYKLIRKSGKDMWGIREFEEGKTAAERRVNRIARRRRQRETARIGLLKEYFHDAIVAVDPLFYQRLDNSRYWPEDKDAVLSSKNSLFHDKDYTDADYYREYPTIFHLRMELIKNPKPHDVRLVYLALLNMFKHRGHFLLNGNLSEDSGSDMGTLCRACLERFEEIDISLVGVSGDEIENVLSLRDLSRSGKAEKLMDLLNISNKQKKEVLWVKAICGLKVDVTKLFNSINTEEKLDLCFADAGFEEKVPEITEAIGEENAQILFLMKAIFDRGILARLLKGSNYLSEARIKDYEKHKSDLSLLKHLVRKYCTEDVYDKMFRAPEAGSYSAYVNSTLTGDEKKRRNMGGRSREDFYKTVKNCFKDIKTPDDDLQRVLRDIDNEDFMPKQLTASNGVIPNQLHQKEMERILDNARKYLPFLNQKDERGLCVYERILRLFTFQIPYYIGPVTENSSKNGGTGWVVRKEKGQVLPWNFQDKIDIPATSEQFIQRMVRNCTYMSGEKVLPKSSLLYESYCVLNEINNIRINGEKITVELKQDLYNDLFKKGRKVTKKQLVKYLINQGVMKEEAELSGIDVTVNNSLGSYGKFAAVFGPEIETDSGKTMIENIIYWGTVFGQDKNLWKQKIQQNYPEITRTVLKRILGYRFSDWGRMSRTFLEMEGCDKNTGEIRSLIRSMWETNHNLMELLDRNLFTYREDLEKQQKKQFSSLSEITPEVLDDYYFSAPVKKMIWQTFGVIREVEKVMGCPPEKIFVEMTRTDEEKGDKGRKDSRKKVLLEKFRGIKEASRDWRDFIEKEDQSGRLRSKKMFLYISQLGKDMYSGEAIDLDRLFDDNLYDIDHIYPRHFVKDDSIHNNLVLVKKQTNAHKSDTYPLENSIRSNPAVTSLWHLLREKGLITEEKYRRLTGRNPFSEEQQADFIARQMVETGQATKGVSELLKEAVPEASIVYSKAGNVSDFRRTYDLLKSRSVNDFHHAHDAYLNIVVGNAYYVKFTQNPLNYIRKEYRNGTKNGEYNLSKMFERNIVRNGETAWIASEKKDPGTIATVKAMLKRNTPILTRQSFIAHGALTDATVYGKDIAKAKVYLPTKTSDQRLQDVTKYGGLNKAAVAYFSLVEHTVKGKKVRTLEAIPVYLKEKVEMHPEELNIYLTDYLGLKDVSVRMRVVRIQSLIKVDGYYAYISGNNDNRIMLRYAIKL

SEQ ID NO: 3204 - protein, 1358 aa, Unknown
  Description of Unknown: uncultivated organism sequence
  Category: MG91 effectors
  Description: MG91-396 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLIKSIDNVCDTDIEYIKNEIEKENFLPKQLTFKNGVIPNQIHASELKAILKNAEKYLPFLNEKDESGYTVSERILMLFSFQIPYYVGPVSPNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGAAISGKMLISKNITDAKECLLINQSVTGLYENRIDLLRV

SEQ ID NO: 3205 - protein, 1107 aa, Unknown
  Description of Unknown: uncultivated organism sequence
  Category: MG91 effectors
  Description: MG91-397 effector
MNILSLDLGITSIGYSILEKKENNRYSLIDYGVSMFDAPFDKDGKSKKLLHSTNTSMSNLYAKRKQRKKALANLFEKFGLAKAQKLLQQEKQNIYKNKWQLRCKDVFERKLNIGEFFTILYFIAKHRGYKSLDTNELLEELCEELKLDCGLKSSQKDDEKGKIKQALKRVEELKQNTNKTVAQIIYEIESKKQTPTFRNHDNYNYMIRREYIEDELKKLVESQVKFGLFGNTFDKEKFINELKEIIVKQKESSNDLNLFANCEYYKEHKVANQYSVVADIFKMYESVINIKLNKEKITKEQIQLIADDFFTKIKKGKNIPDIKYKDIRKILKLSDDIKIFDKKDSYVRKGKTIHHTITKFHFLNNLSKFDNSFIVENLKNLENLAEIFEVLNKEKSPKTIFEQLKGKVDEKTIIELIKYKNGKSLNISHYAMLKFIPYFQEGLTTDEIKKKLDLNRNEDYSKYKKGIKYLHVNQFEKDDNLEINNHPVKYIVSAVMRVVKHLHTLYGPFDEIKVESTRELSLPKKVKDKIDKVNKDNEAKYLAVLKNEAYLSAAKYHNKNIQKYKEQLVLYEEQEGRDIYTWQGIEIDDIFKDKLEVDHIVPQSLGGLSVKHNKVLCFKNSNATKGNRLPMNYIKDTESFRKNIEYLYTKKVINGKKLKNLLATNLDEIYKDTFESKSLRATSYVEALTAQMLKRYYPFADKQKQKDGNAVMYIQGRATANIRKLLHVKAKTRGTNIHHAIDALIIGVTSHSWLKKISNTFRENYGVIDDKARENIKKELPLIEGVSVAELVAHIEENYNFDGEESVFYRDIFGNVKVVPFWVSKKSMVSKIHKDTIYAKKPDGIFTVREKILDKFIALKITPTTSPDEFMKKFQKEILEKMYLYKTNPKDKICQIIQQRAFDIAQLLDNLQLEDTTDKEMLSETKKYLDEFIHQDLKDHNSNVIRKVQFYQTNLTGFEIRGGLATKEKTFIGFSATLNGDKIEYKRIDVANFETIKKDAGFKVYKNDIVFFIYPDGSFKGGKIVSFLEEKNVASFSNLRYPANINLQPHSFVTLFKGKANSHKQHSINKAIGIIKLHLDIIGNIKSFSSLGEVDSELLSFLKKLKD

SEQ ID NO: 3206 - protein, 1358 aa, Unknown
  Description of Unknown: uncultivated organism sequence
  Category: MG91 effectors
  Description: MG91-398 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERISMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCHPTRIFIEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKNGYDKFVNLTTEEQIKLLIEIIKLTCVGIVSANLTLIGGASISGKMLISKNITDAKECLLINQSVTGLYENRIDLLRV

SEQ ID NO: 3207 - protein, 1358 aa, Unknown
  Description of Unknown: uncultivated organism sequence
  Category: MG91 effectors
  Description: MG91-399 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELLGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKTANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3208 - protein, 603 aa, Unknown
  Description of Unknown: uncultivated organism sequence
  Category: MG91 effectors
  Description: MG91-400 effector
MAKENFVLTLPLRVDKCQADILDKRYELLRLIYNMVQQKLVRQYIYFSQQKAFKACESFEQKREFFNTHPFHFKGIKGKNGELCDIKFPYTYESRSSSSGKRPSGGISDYVSKLWSHKVGADKRLVDFGLNGSIMEELGLHVMKAWEDRLYKYKTKRVSFKGYGAINSLGCRYHKGNFAGFTINLEEGFITFNTNGRHGQFADIITLPIDFSREKKGYAAEAFKSGVDSLRKLIIVRRCIRGRNKYYLQLTISGEKPQKGRTLGKGNVGIDIGPSTIATSSLQGVHFDKLADKCDNIEHELYLINRKLDRSRRVNNPENYNPDGTIKRGVRLVWKKDKDVRRYASLKQQRKELYRKQAETRKQQHLEMANAILSQGDTFIVENNPIDAWVRRAKETKKNKTGKIRCKKRYGKSVANHAPAMFVSILKNKVQSLGGMFREVDPGYAATQFDFTNGVFTKHEVSERSITLSNGRTHQRDMLSAFNLQHIGQELKEYDIEQMQADYSIFCRLEAAEQERFKETRRNERDALYFVGAFAKKLRHEPQEETVANRHNGGVGRKHCNTLCTENAKITGSGLVRESIERVSEAPEECHHIGNQPIILDGL

SEQ ID NO: 3209 - protein, 1347 aa, Unknown
  Description of Unknown: uncultivated organism sequence
  Category: MG91 effectors
  Description: MG91-401 effector
MEEKEYYLGLDMGTNSVGWAVTDPQYTILRAKGKDMWGIREFESAETAEKRRGHRTSRRRRQREVVRMGLVKDYFSDAINNVDGNFYARLENSKYHLEDKDEAVRNKNGIFADEHYTDKEYYAEYPTIYHLIMELINNPAPHDVRLVYLAVANLFKRRGHFLNAGLSEDGGNQSMQTAYDGFNTTCNETLGFSFPGINATQIEEVLKNRNYSKTVKSEKLAELLGVEKKEKQRIEILRAIAGRKVNAKVIFPNVETEDKVEFSFSDAAFDDNATELMTLLGDECYSLVLCMREMYDIGTLAEIMHGCQYLSESRMADYQKHHEDLVLLKSVIKSECTQKQYDELFRLDGEGSYSAYVNSTLAKNHKQRRSMKGRTRDDFYKKVRGLIGKSSNPDAIKICTEIENETFMPKMLTSANGIIPNQVHYKELKAILSNAEKYLSFLLEKDESGLTTSDRIQRLYKFRIPYYVGPVSNRDGKGNGWAVRKEEGTVLPWNLEEKIDLSKTKEAFIENLIRRCTYISDEKVLPKNSLIYEKFTVLNEINNIRINDERISVDLKQDIYNELFKKGKKVTRKTLAKYLINRGVIEAENQISGIDIAINNSLSSYGKFKAVFGESMDTDTTKKMVEDIIKTSTIYGDDKRELKNILRDKYGEILSEDQIKRIAGFRFKDWGRLSRAFLELAGADCRTGEVTSIIQALWESQLNLMELLHSEDYTFGESLNEKLVKNEKSLSEITAEDLDDYYFSAPVKRMAWQTILLIKEISKIKGCEPSKIFIEMTRTDEEKGDKGRKNSRAKELTALYKNIKKEGKAWIELIGKEDASGRLKSKKMYLYIKQMGRDMYTGEQIDLDRLFDDNLYDIDHIYPRHFVKDNNIENNLVLVNKAKNSRKSDNYPLDSDIVRNPKVRELWEMLHTNHLMSDEKYHRLTSRKAFTDEDMAGFIARQLVETGQATKGVADLLKELTSSEIIYSKAGNVSDFRHAYDIPKSRIVNEFHHAHDAYLNIVVGNAYYTKFTSNPLNYIRNEYKKNTKENNYHLNKIFESTISRNGYVAWLAGSDKNPGTIQTVKKMLSRNTPLMTRMTFVIHGSIAKETLCGKNIAKEDSYLPLKGSDPRMSVEKYGGFNKASGAYFFLVEHELKGKKVRTIETVPVYLMKKLSDERELQKYCEEKLGLINPSIRLKQIKMQSLIKLNGYFVNVTGRTNKQLTLRNAVNLKLDKEDIYIIHLVEKCIGEERDDRLSEESILSLYQTLTEKQASGIYRNRPNSVYEKLNEGMIRFKNLERKQQIKVLANILNLTMVGKAQADLKDIGGSANSGVMLMAKKINNYNEVKLINQSVTGLYQTEVDLLTV

SEQ ID NO: 3210 - protein, 1115 aa, Unknown
  Description of Unknown: uncultivated organism sequence
  Category: MG91 effectors
  Description: MG91-402 effector
MRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNREFPKSRLVNDFHHAHDAYLNIVVGNVYYVKFTQNPINYIKNSYNKDMNKNNYNLSRMFDWDVKRGDEVAWIAQKQDGAAGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDVRVRKIKIGSLIKYNGYFCYITGKTGYRLIVRNATNLCLASNWRKYIKKIEKYKETTIIDNVITAEENIKLYNELLNKFTVGIFGRRPNPIGEKMDSARDKFASLSIENQCLALYQILQLTAILGNESDLQLIGASTHAGKMLISKKIGTDEIYLINQSPTGLFETKIDLQTI

SEQ ID NO: 3211 - protein, 1356 aa, Unknown
  Description of Unknown: uncultivated organism sequence
  Category: MG91 effectors
  Description: MG91-403 effector
MGRDYYLGLDMGTSSVGWAVTDEKYNLLRAKGKDLWGIREFEEAEGGIARRQNRISRRRRQREQVRIGLLKSYFAEEIEKVDPDFLQRLENSKYHLSDKDEKVRYKSAIFNDPEYTDKDYYRDYPTIFHLRAELIHNQEPHDIRLVYLALLNMFKHRGHFLNASLSAEEETQSMSDAYTAFRALVEEVMTANETENLFFPDGKADEIEAIISSRDYNRKRKSELMTEMLGFTKKDKAAQALIKGMCGLTVDVKTVFREIESEAKLSISFSDSNYDEKIVEIQEVLDDEQLELLEAVKTIYDIGSLAGVLKGEKYLSDARITDYNKHKEDLALLKKIIRKYTDQKTYNDLFRGTEPGSYSAYVNSTNSGKKQRRNMGGNAKRNQEAFYASLKKLLNKLPSEDDDVQKILADIDKELFLPKQLTFANGVIPNQVHAREMKAILNNAEQYLPFLTEKDESGLTVSERILKLFSFQIPYYVGPVTTKSSRDGGNGWVVRKESGQVLPWNIEDKIDMDATSKKFIENLIRECTYIAGEKVLPKGSLLYERYCVLNEINNIKIDGRPIDVELKQKIFEDKFMSGKKVTRKQLVTYLHGKGVLEDDAQLTGIDKTINNSLSSYGKFLGVFGDELKKDSCQIMVEDIIRDCTIYGDSKKRLRETLQKKYVDNNNLSESQLKRILGFKFKDWGRMSKEFLEMQGINRETGEVMSLVQAMWETNLNLMELIYSEDFTFAEALQEKQAKDYLTLSEFKFEDLDEYYFSAPVKRMVWQTLLIIKELEKVLGAPPKKVFIEMTRSDGVKGDRGRTISRKKQFEDLYKKIKDESQDWASIIDNADASGKLRSKKMYLYLTQMGKCMYTGKPIDLDDLFDDNKYDIDHIYPRHYVKDDNLGNNLVLVEKKANASKGDRYPLDTDIRGKMHGTWKFLKEKGLITEEKYRRLTGSNPFSEEQQADFIARQLVQTSQGTKGVADLLKQLLPDAKIAYSKASNVSDFRRDYDLPKSRLINDFHHANDAYLNIVVGNAYLVKFTQNPLNYIRSGDVQYNLGRMFEKDIVRNGEVAWLADDGKGNHGTIVTVKKVMARNTPMMTRMVLNGHGAIANATLYPASKASADNYIPLKGSDSKIADVTKYGGFTSVSTSRFVLVEHLVKKERIRTLEALPILVANSCKTMEDIENYCEEELGLIAPKVKLDGIKIQSLLKINGFYVHLSGKTNKQLALRNAVNLCLDAKWKEYIHYLEKASNNGNYGNPICSDMNIELYSILAEKHSSSIFAKRPNPVGTKLVKEKETFSKLELVDQVSVLLQILQLSAIGITQADLRAIGGAGIAGKMLISKDISKQEEALLIMQSPTGLYESTIDLKTI

SEQ ID NO: 3212 - protein, 1356 aa, Unknown
  Description of Unknown: uncultivated organism sequence
  Category: MG91 effectors
  Description: MG91-404 effector
MGRDYYLGLDMGTSSVGWAVTDEKYNLLRAKGKDLWGIREFEEAEGGIARRQNRISRRRRQREQVRIGLLKSYFAEEIEKVDPDFLQRLENSKYHLSDKDEKVRYKSAIFNDPEYTDKDYYRDYPTIFHLRAELIHNQEPHDIRLVYLALLNMFKHRGHFLNASLSAEEETQSMSDAYTAFRALVEEVMTANETENLFFPDGKADEIEAIISSRDYNRKRKSELMTEMLGFTKKDKAAQALIKGMCGLTVDVKTVFREIESEAKLSISFSDSNYDEKIVEIQEVLDDEQLELLEAVKTIYDIGSLAGVLKGEKYLSDARITDYNKHKEDLALLKKIIRKYTDQKTYNDLFRGTEPGSYSAYVNSTNSGKKQRRNMGGNAKRNQEAFYASLKKLLNKLPSEDDDVQKILADIDKELFLPKQLTFANGVIPNQVHAREMKAILNNAEQYLPFLTEKDESGLTVSERILKLFSFQIPYYVGPVTTKSSRDGGNGWVVRKESGQVLPWNIEDKIDMDATSKKFIENLIRECTYIAGEKVLPKGSLLYERYCVLNEINNIKIDGRPIDVELKQKIFEDKFMSGKKVTRKQLVTYLHGKGVLEDDAQLTGIDKTINNSLSSYGKFLGVFGDELKKDSCQIMVEDIIRDCTIYGDSKKRLRETLQKKYVDNNNLSESQLKRILGFKFKDWGRMSKEFLEMQGINRETGEVMSLVQAMWETNLNLMELIYSEDFTFAEALQEKQAKDYLTLSEFKFEDLDEYYFSAPVKRMVWQTLLIIKELEKVLGAPPKKVFIEMTRSDGVKGDRGRTISRKKQFEDLYKKIKDESQDWASIIDNADASGKLRSQKMYLYLTQMGKCMYTGKPIDLDDLFDDNKYDIDHIYPRHYVKDDNLGNNLVLVEKKANASKGDRYPLDTDIRGKMHGTWKFLKEKGLITEEKYRRLTGSNPFSEEQQADFIARQLVQTSQGTKGVADLLKQLLPDAKIAYSKASNVSDFRRDYDLPKSRLINDFHHANDAYLNIVVGNAYLVKFTQNPLNYIRSGDVQYNLGRMFEKDIVRNGEVAWLADDGKGNHGTIVTVKKVMARNTPMMTRMVLNGHGAIANATLYPASKASADNYIPLKGSDSKIADVTKYGGFTSVSTSRFVLVEHLVKKERIRTLEALPILVANSCKTMEDIENYCEEELGLIAPKVKLDGIKIQSLLKINGFYVHLSGKTNKQLALRNAVNLCLDAKWKEYIHYLEKASNNGNYGNPICSDMNIELYSILAEKHSSSIFAKRPNPVGTKLVKEKETFSKLELVDQVSVLLQILQLSAIGITQADLRAIGGAGIAGKMLISKDISKQEEALLIMQSPTGLYESTIDLKTI

SEQ ID NO: 3213 - protein, 1356 aa, Unknown
  Description of Unknown: uncultivated organism sequence
  Category: MG91 effectors
  Description: MG91-405 effector
MKTGNYYVGLDMGTNSVGWAVTDSKYNLIRAKGKDLWGIREFEEARTAADRRSKRVARRRRQRQQVMMGLIRSYFEDEINKIDSQFFQRLDNSFYYLEDKDNAIKDKNVLFNDKNYIDKDYFHEYPTIFHLRKSLIDGTARHDVRFVYLAIINMFKHRGHFLNASLDSDHAYIPMKEILSIFDETASALEKNTWPSLSDFSEQIDKILCDRKISKSKKTEKLNEILGLEKKDEFCEFVKVICGLKSNTAKLFKVEGDETEKKDICFSDAGFDDSLSEIMDVIGEENTELLNSMKNIYDCGVLGEILSGYSFLSEARVALYKKHGDDLKSLKRILKKYNMENEYDFLFREAEAGTYSSYVGSVNCDGNKQRRGMKGRSKEDFYKTVKKILDPLMKSHPQDQDIAFVLEEISKDTFMPKQLTSSNGVIPNQVHAIELKMILKNAEEYLSFLKNKDESGLTVSERIVQLFSYQIPYFIGPTSDKSEKSGGNGWVVRKEPGPVLPWNIEEKIDIGLTNEKFIEKLVRTCTYISGEKVLPKNSILYQKYVVLNEINNIRIDGEKISVELKQDIFNELFLKSNRVTRQKLIKYLNNRGCIQDETQISGLDIKINSGMSTYAKFYSLFGDKMKEDSYVQMAEEIIFLCTVYGDSKKYLRERLIQKCGDSLSEDEIKKIMTMKFSDWGRLSREYITLAGCDKTTGEECTLIGALWNTNLNAMELINNDQFTFHEVLESRRAKDLNTLKDFKSEDLADYYYSAPVKRMIWQTIQILREIESVMGCSPEKVFVEMARRPEDRPKRKDSRKQMFLELYKNIKDEDRNWKELIEREDETGRLRSKKMYLYLTQMGRDMYTGDPIDLDKLFDNNLYDIDHIYPRHYVKDDSIENNLVLVYKPQNANKSDIYPLEKTIRDKQYGFWKGLRNQKLISEEKFNRLVGTKPFTEDQLAGFIARQMVETQQGTKGVAELLGTLLEDSRIVYVKAGNVSDFRRKYGFPKSRIVNDFHHANDAYLNIVVGNVYDVKFTQNPLRFIKDEYLKDKSRNQYNLDKMFDRNIERNGKIAWKAPTEDGEQGTIVTVRRVISKNTPLMTRLSFVGHGQISDETLYGHDDAKAGVYIPFKSRDARLSNVERYGGYNKASIAYFFLVESDNKGKRERTLESVPIYLSGQIKTENDLINYCLNTLGLIKPSIRIAKIRIQSLVEKNGFRFHITGKTNDRLTTRSATSLYVGSDKQSYIHKIEKYIDTGVIEEIMTKEKNIELYDLLTEKHCSGVFSKRPNPVGEKLKLRKEKFKALELPDQLDVLNQVLTLSSIGKAEADLTKIDESKKTGVMLISKKISPEDPVILISQSAIGLYENRINMATV

SEQ ID NO: 3214 - protein, 1119 aa, Unknown
  Description of Unknown: uncultivated organism sequence
  Category: MG91 effectors
  Description: MG91-406 effector
MKQILSLDLGITSVGYSVIQEHETDKYSLIDYGVSMFDKPTDKDGNSKKLLHSQALSAKNLHKLRKKRKQNLASLFDQYHLANKQKLLEQERDNLYKNKWELRAKKVFEEKLSVDEIFTILYHIAKHRGYKSLDSGDLLEELCDSLGIETETAKPKKDDEKGQIKQALKSVEALYEEYPQKTVAQIIYELESKKENPIFRNHDNYNYMIRREYINDEIRKIIKAQIAFGAFRAIDDAFINDVIAVIDDQKESTNDLSLFGKCEYYPEYYVAHQYSLLSDIFKMYQAVANITFNKEKIKITKEQIALIAEDFLGKIKKGKSVKDIKYKDIRKVLKLDDDIKIFNKDDSYLNKGKKQENTITKFHFVDTLSKIDKSFVEDIFASDESYRLMREIFDVLHYQKSPKLIYEQLKNKISDEQVIIDLIRNKKGSSLNISSFAMLQLLPYLEEGLTLDEVKQKIGLQRQEDYAQYKKGIKYLHITSYEKDDELEINNHPIKYAVSAALRVVKHLHAEYGTFDEIKVESTRELSLGEKARKEIEKANRAFEKEIEQIVENAEYQKIAKSYGKNLRKYARKILMWEEQERLDIYSGKSIGITDIFSNSVDLDHIVPQSLGGLSVKHNFVLVHRDENLQKSNQLPMNYIKDTQAYTNRVEHLLREHKINWKKAKNLLATNLDEVFKDRLESKSLRATSYIEALTAQMLKRYYPFKDVQKLKDGSAVRHLQGRATSNIRKVLGVMTKSRETNIHHAIDAILIGVTSHSWLQKLSNTFRENFGCIDDEARKNIKKALPYMDGMEIKDLVKEIEEQYNSFGEDSIFYRDIWGKVKTVNFWVSKKPMSSKIHKDTIYAKKGDGIYTVRENIIAKFIGLKVIPMTSPEEFMKKFHKEILQKMYLFKTNPQDVICKLVEQRGEEIKELLWSFEFLDVKNKEQMSEAKTKLELLIHKDLLDNNGNVIRKVKFYQTNLTGFDVRGGLATKEKTFIGFRAYKEDSKLEYERIDVANVEKIQKTNDGSFKAYKNDIVFFIYNDGSFKGGRVVSYIKKSSGSKLCAFLNPRFPTASEYQPSSFCKIEKGKHSGAKQQSIGSAKGIIKLNLDTLGNIKSYQVLGNVESKILDEIKSIVSH

SEQ ID NO: 3215 - protein, 610 aa, Unknown
  Description of Unknown: uncultivated organism sequence
  Category: MG91 effectors
  Description: MG91-407 effector
MAKETFVLTLPLKVEKWQADILDKRYELLRQVYNMVQRKLIRQYIYFSQQKEFKDCRNDYKRLREFFASHPFHFRGINGKNGEPSDIKFPYTYESRSSNSGKRPSGGISDYVSKLWTHRIGEEKTLSNFGINSYILEELGLHIMKAWEKRLYDHSSSRVSFKDYGDINSFGSRYKKGNFAGFTINLEEKIITYNANGRQGRYADLIKLPIDFSRDKKYYAVSALKGGIDSLRKLIIVRRCIRGRHKYYLQLTIAGEKPQKGRTLGSGRVGIDIGPSTIAVSSLNGVHFEKLADKCDNIEHELYLVNRKLDRSRRASNPQNFNDDGTIKRISRQKGERRIWNESSRYKQLKQTRRELFRRQAEVRKQQHLEMANAMLSQGDTFIVENNPIDAWVRRAKETTKTKTGKNRCKKRYGKTVAHHAPAMFVSILENKVKSLGGRFYEVDPRNAATQFDFTNGEFTKHEVNERSITLSNGRTHQRDMLSAFNLQHLRPESKETKDYDIEQMQADYPFFCKLEAAEQKRFTETRYNERDALYYVGAYKKQLRRQPQKESVANRHNGGVGRKHCNTSLGSENAKITGNGFVRESIERVSQVPDECHLFVSDPIVLDGL

SEQ ID NO: 3216 - protein, 1122 aa, Unknown
  Description of Unknown: uncultivated organism sequence
  Category: MG91 effectors
  Description: MG91-408 effector
MKKILSLDLGITSIGYSVIEEFGNDRYSLIDYGVSMFDKATDKDGNSKKLLHSASTSTSKLYDLRKKRKKDLAQLFHNFGLGDKNSLLSQEKQNIYKNKWYLRCHKAFKEKLNINELFTIFYTLAKHRGYKSLDSSDLLEELCEKLNIPLETKTKKDDERGKIKKALKTIEELKQNSTKTVAQIIYEIELKKENPTFRNHDNYNYMIRREYIDQEIEKIIKTQKDFGLFDDKFDIDNFIEKLKDIITYQNPSTNDMRLFGNCEYYEDEKAAHQYSVISDIFKMYESVSNITFNTKPSIKITKEQINKIADDFFTKIKKGKNIADIKYKDIRKILALSDDTKIFNKDDSYISKGKKVEHTIIKFHFVNNLSKFDNSFIVENLNSLENLKEIFEVLQFEKDPTAIYEKLKDKIEDKQTIINLIKHKSGNSLNISAKAMVEFIPYFKDGLTTDKIKEKLELNRCEDYSKFYKGIKYLNIRQFEQDDNLDINNHPVKYVVSATLRVIKYLHIVCGTFDEIRVESTRELSQNEETKKAIEKANKELEKQINDIVQNKEYQNIAQHYGKNLQKYARKILLYEAQNRRDIYTGEGIEFEDIFTKKVDIDHIVPQSVGGLSVKHNLVLVFRDTNIQKSNQLPMNFVKDKQDFINRVEHLFSEHKINWKKRKNLLATNLDEIYKDTFESKSLRATSYIEALTAQILKRYYPFKDKEKQENGKAVSYIQGRATSNIRKILKVKTKTRDTNIHHAIDAILIGLTNQSWLQKLSNTFRENFGKIDEEARANIKKDMPIFEIIIDDEVKYLEPKELVELIEKNYNYDGENSIFYKDIWGKIKSVNFWVSKKPMVSKIHKDTIYSKKDDGIYTVRENIINHFINLKITPKTSSKKFEEEFNKKILNKMYLFKTNPKDAVCKAIIKRANDIKTLLDSFIDIDTKDKEAMNNAKTKLDELIHKDIPDNNGKPIRKIKFYQTNLTGFDVRGGLATKEKTFIGFKAQIINGKLNYTRIDVANIDKIKKENDNSFKVYKNDLVFFIYTDGTNKGGKIVSFLEDKRIAAFSNPRFPSSIGFQPHFFVTIFNGKANSHKQHSLNKAIGIIKLNLDILGNIKSYQKIGSCESELLEFIKKVIKD

SEQ ID NO: 3217 - protein, 1358 aa, Unknown
  Description of Unknown: uncultivated organism sequence
  Category: MG91 effectors
  Description: MG91-409 effector
MQETGKDYYLGLDMGTNSVGWAVTDENYVLMRAKGKDLWGIREFDEALTAVDRRTHRVARRRRQRETARIGLLKEYFHDAIAEADPNFYQRLDNSKYHEEDKDSAVKGKNGIFNDANYTDKDYFKQYPTIFHLRTELIESTEKHDVRLVYLALLNMFKHRGHFLNAGLSTESENTMDTAYHNFVETAAQTIECNFMETVDIEKIKEILGSRDYSRSKKAELVAQLLHVDSKNKVQMACIKCICGLKVTAAAIFGDKMAADEEKKTDICFSDFGYDEKVPVILETVGEENFELVLAMQEIYDIGSLAGIMKDSLYLSMARVKEYEQHGKDLKILKGVVKKYATKEEYDTLFRTMEEGTYSAYVNSVNTKKKSRRDVKKRTRDEFYGRLKKIISTMPQDDSDVLYIKDKMEKEAFLPKQLTASNGVIPNQIHAREMKKILQNAETYLPFLKEKDTSGLTVSERILKLFSFQIPYYVGPVSEKSKLNGGNGWVVRKEEGTVLPWNIEEKIDMTATSREFVERMVRRCSYLSDERVLPKGSLLYERFCVLNEINAIKVDGVKIPVEIKQDLYSKYFKKGKKVTRKKIAEFLIARGVIKEDQTELISGIDIAVNSTLSTYAKFYAIFGEKMEQDSYKKMVEQIVEWCTIYGDAKKFLEQKIKECYGNILTQEEIKRITGFKFRDWGRLSKEFLELSGCSKATGEVMPLISMMWETNDNLMELLDDNYYTYREALEEKQNNAFKLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQRGRCMYTGHPIDLEDLFKDNRYDIDHIYPRHFVKDDNIMNNLVLVEKEKNAHKSDNYPLEEEIYKKQLPVWKDLHQCKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTIVTVKKMMAKNTPMLTRLSFEGKGGLADQTLYSAEKAKGNGYIPLKTSDAKMQDVTKYGGFNSVSTAYFFLVEHELKGKKVRTLETVPIIWRDRIEKDETMLLKYCTDVLELKNPSIRVKKIKLQSYIKKDGYYMYITGKTNKQITTKNAVELCVNQRWIDYIKIIEKTVEKKKECEEVNYNKNVEFYDLLLTKHTQEIFSNRPNPVGAKLKQGRDKFLSLTLFEQSTVLYEILQLSIIGNTRADLHSIGGAPISGVMLLSKKITDSKEFILINQSVTGLFEQKVDLLTV

SEQ ID NO: 3218 - protein, 1122 aa, Unknown
  Description of Unknown: uncultivated organism sequence
  Category: MG91 effectors
  Description: MG91-410 effector
MKKILSLDLGITSIGYSVIIEEEIQRYSLLDYGVSMFDKPTDKDGNSKKLLHSQAISAKKLHQLRKERKKNLAKLFEKYNLASAAKLLGQEKKNIYIHKWQLRAKKVFEEKLSVEEIFTIFYHIAKHRGYKSLDSGDLLEELCVDLGIELEQKKEKKDDEKGKIKQALNNIESLRQEYPEKTVAQIIYDVELQKEQPVFRNHDNYNYMIRREHINDEIVTIISKQKEFGNFENIDSEAFIADLIAVIDDQKESTNDMSLFGKCEYYPKEYVAHQYSLLSDIFKMYQAVANITFNKEKIKISKEQIRLIAEDFLNKIKKGKSVKELKYKDVRKVLNLDDSIKIFNKEDSYQRAGKKVENTITKFHFVDTLFKIDKSFIEDIFSADESYALMREIFDVIHKEKSPKRIYEQLKDKVSSEAVIIDLIRYKKGSSLNISSYAMMKFLPYFEEGMTLDAIKEKLNLNRKEDYSEYKKGIKYLHISTYEKDDSLEINNHPVKYVVSAALRVVKHLHAKHGAFDEIKVESTRELSLNDKVKKEIEKVNKEREKEIEKIVSDKEYQTIAQDYGKNIHKYARKILMWEAQERFDIYSGQSIGLDDIFSNRVDIDHIIPQSLGGLYVQHNLVLVHRDENLQKSNQLPMNYIEDKEAYINRVEHLFSEHKINWKKRKNLLATNLDEIYKDTFESKDLRATSYIEALTANILKRYYPFTDEKKSADGSAVRHVQGRATSNIRKVLDVKTKSRESNIHHAVDALLIGVTNHSWLQKLSNTFRENFGKIDDEARQNIKKTLPYIDGVEVKDIVKEIEQNYNSLGEDSIFYKDIWGRVKTVSFWVSKKPMSSKAHKDTIYADKGDGIFTVRESIIAKFINLKITPTTSPEDFMKKFHKEILEKMYLYKTNPNDVICKIVEQRAEEIKELLWSFEFLDAKNKEEMQEAKAKLENLVHRELFDNNGNVIRKVKFYQTNLTGFKVRGGLATKEKTFIGFRAIKKGEKLEYERIDVSNFEKIKKSNDGSFKVYKNDIVFFIFDEENFKGGKIVSFLEDKTIASFSNPRFPAAIKFQPDSFCIIGKDSNGKPKKSSSKQYKLGKAKGIIKLKIDILGNIESYQVLGNAKSKLLDEIKSIVSH

SEQ ID NO: 3219 - protein, 1358 aa, Unknown
  Description of Unknown: uncultivated organism sequence
  Category: MG91 effectors
  Description: MG91-411 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVTGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKDSLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3220 - protein, 1117 aa, Unknown
  Description of Unknown: uncultivated organism sequence
  Category: MG91 effectors
  Description: MG91-412 effector
MAHMKKILSLDLGITSIGYSILDELENDRYSLLDYGVSMFDKPTDKDGNSKKLLHSASMSQTNLYNLRKKRKENLAQLFEEFSFGKKEDFLQQERENLHVNKWELRAKKAFQEKLEVSELFSILYLLAKHRGYKSLDSDDLLEELCQKLELHVDITKKKKDDERGKIKAALVNIEHLREQYPHKTVAQIIYEVEKSKQNPTFRNHDNYNYMIRREYINDEIKKIIKAQESFGLFNFTTDEFIAKLIATIDDQKEATIDPSLFGNCEYYPQEKVAHQYSLLSDIFKMYQSVANITFNKEKVKITPQQIHLVANDFFSKLKKGGKNIVDIKYKDIRKVLKLDENIKIFNKDDSYLNRGKKQEHTITKFHFVANLSKMDNTFIIEILEKANPYEIFREIFDVLAYEKAPQTIYDKLKDTIDDETIVSLIKYKNGKSLNISHYAMTRFLPFFEQGLSTDEIKKKLNLERKEDYSQYKKGIKYLHVKSFEHDENLEINNHPVKYVVSAVLRLIKHLHVNHGPFDEIRVESTRELSQNEQTKKDIVKANRALEKEIDVIIANEEYQKIAQHYGKNLRKYARKILMWEEQERFDIYSGKSIGFEDIFTNVVDLDHIVPRSVGGLSVKHNFVLAHRDINVQKSNRLPLDFVVDTEAFINRVEHLFAEHKINWKKKKNLLATTLDETFKDTFESKDLRATSYIEALSAQILKCYYPFTDKKKQHDGSAVRHIQGRATSNIRKLLHVKTKVRDTNIHHAIDAILIGLTNRSWLQKLSNTFRDNLGVIDDEARAKIKKEMPLIEGIEPKELVTMIEDAYNFYGEDSVFYKDVWGKIKVVNFWVSKKPMVSKIHKDTIYAKKEDGIYTVRESIIDKFAELKTTTTTDADTFMKSFEKNVLHKMYLHKTNPKDFTCKAVTNRADAIYELLKSFDSLDKKDKALMSEAKAKLDDLIHRDILDNNTNVIRKVKFFQTNLTGFNIRGGLATKEKTFIGFKAELKDDKLCYERIDVANFNTIKKENDKSFKAYKNDVIFFMYGDGSFRGGKIVSFLEDKKIAAFSNPKFPVSYKFQPDSFCKDKAHTGAKQHALNKAIGIIKLNLDITGKIKSYQSIGTIESELLQFIKEAIHG

SEQ ID NO: 3221 - protein, 603 aa, Unknown
  Description of Unknown: uncultivated organism sequence
  Category: MG91 effectors
  Description: MG91-413 effector
MAKENFVLTLPLRVDKCQADILDKRYELLRLIYNMVQQKLVRQYIYFSQQKAFKACESFEQKREFFNTHPFHFKGIKGKNGELCDIKFPYTYESRSSSSGKRPSGGISDYVSKLWSHKVGADKRLVDFGLNGSIMEELGLHVMKAWEDRLYKYKTKRVSFKGYGAINSLGCRYHKGNFAGFTINLEEGFITFNTNGRHGQFADIITLPIDFSREKKGYAAEAFKSGVDSLRKLIIVRRCIRGRNKYYLQLTISGEKPQKGRTLGKGNVGIDIGPSTIATSSLQGVHFDKLADKCDNIEHELYLINRKLDRSRRVNNPENYNPDGTIKRGVRLVWKKDKDVRRYASLKQQRKELYRKQAETRKQQHLEMANAILSQGDTFIVENNPIDAWVRRAKETKKNKTGKIRCKKRYGKSVANHAPAMFVSILKNKVQSLGGMFREVDPGYAATQFDFTNGVFTKHEVSERSITLSNGRTHQRDMLSAFNLQHIGQELKEYDIEQMQADYSIFCRLEAAEQERFKETRRNERDALYFVGAFAKELRHEPQEETVANRHNGGVGRKHCNTLCTENAKITGSGLVRESIERVSEAPEECHHIGNQPIILDGL

SEQ ID NO: 3222 - protein, 530 aa, Unknown
  Description of Unknown: uncultivated organism sequence
  Category: MG91 effectors
  Description: MG91-414 effector
MTSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPGKKVLNWCGHDYRVLIDPKDDYIQRALKENERSDQYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTINKGAKLAKSKNYQRKVDQLHEMHRVAAAQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3223 - protein, 530 aa, Unknown
  Description of Unknown: uncultivated organism sequence
  Category: MG91 effectors
  Description: MG91-415 effector
MTSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLAPEPKAMTPEMARQKILRGAGDSHLPTDQALGRIRAGGKVSTWSKETFPLQRGVV

SEQ ID NO: 3224 - protein, 530 aa, Unknown
  Description of Unknown: uncultivated organism sequence
  Category: MG91 effectors
  Description: MG91-416 effector
MPSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFWQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLAPEPKAMTPEMARQKILRGAGDSHLPTDQALGRIRAGGKVSTWSKETFPLQRGVV

SEQ ID NO: 3225 - protein, 530 aa, Unknown
  Description of Unknown: uncultivated organism sequence
  Category: MG91 effectors
  Description: MG91-417 effector
MTSPSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDQLHEMHRVAAVQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKAAVEQLEGAKQLLTDAGYVVLKSTSSRDQRDPRLAPEPKAMTPEMARQKILRGAGDSHLPTDQALGRIRAGEKVSTWSKETFPLQRGVV

SEQ ID NO: 3226 - protein, 497 aa, Unknown
  Description of Unknown: uncultivated organism sequence
  Category: MG91 effectors
  Description: MG91-418 effector
MTSPTFIIELPIRVSDSESRTILRKLEFARQLHNATLGTALGQLQQLRQDSEWEKACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYCVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNPDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3227 - protein, 444 aa, Unknown
  Description of Unknown: uncultivated organism sequence
  Category: MG91 effectors
  Description: MG91-419 effector
MQGTGKAAGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRTRSSDRFFLQVVLEGAAPVKHVYAPVTERAAIDPGPQSIALFSKAFAGKIQVAGSNNFNEAASRRLLRAMDRSLRRNNPDAYNEDGTIKKGAKLAKSKNYQRKVDQLHEMHRVAAAQRKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGRGQYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3228 - protein, 530 aa, Unknown
  Description of Unknown: uncultivated organism sequence
  Category: MG91 effectors
  Description: MG91-420 effector
MPSQSFVIELPIAVDDAEMRTIVRKLEFARQLHNATLGTAMGQSQQMRQDAAWKEACVMPKGKERAAAFRALDRKYGLTEYDLHSIIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFWQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLAPEPKAMTPEMARQKILRGAGDSHLPTDQALGRIRAGGKVSTWSKETFPLQRGVV

SEQ ID NO: 3229 - protein, 530 aa, Unknown
  Description of Unknown: uncultivated organism sequence
  Category: MG91 effectors
  Description: MG91-421 effector
MTSPSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAESAGLKVTEVNPYKLKLSQYDPYTDTYRKKDLSERWQEMKAGSGQYIQRDVLSALLLYCANIEKEIHIPKVAVEQLEGAKQFLTDAGYVVLKSTSSRDQRDPRLAPEPKAMTPEMARQKILRGAGDSHLPTDQELGRIRAGGKVSTWSKETFPLQRGVV

SEQ ID NO: 3230 - protein, 497 aa, Unknown
  Description of Unknown: uncultivated organism sequence
  Category: MG91 effectors
  Description: MG91-422 effector
MTSPTFIIELPIRVSDSESRTILRKLEFARQLHNATLGTALGQLQQLRQDSEWEKACLMPKGKERSELFRKLDREYQLTEYDLHTVIAKHRQRSGRKTELGINETQKIATRVFQAVNRYKLGLGGRPRFKSLSRGLRSIEGKSNKTGLKFNIEKSVLSWCKHDYCVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNPDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3231 - protein, 530 aa, Unknown
  Description of Unknown: uncultivated organism sequence
  Category: MG91 effectors
  Description: MG91-423 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVAAAERKCRHGQTINLLLSIAGDMRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3232 - protein, 530 aa, Unknown
  Description of Unknown: uncultivated organism sequence
  Category: MG91 effectors
  Description: MG91-424 effector
MTSPSFVIELPIAVDDAEMRTIVRKLEFARQLHNATLGTAMGQLQQMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDQLHEMHRVAAVQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGLYIQHDILSALLLYCADIEKEIHIPKVAVEQLEGAKQFLTDAGYVVLKSTSSRDQRDPRLASEPKAMTPEMARQKILRGAGDSHLPTDQELDRIRAGGKVSTWSKETFPLQRGVV

SEQ ID NO: 3233 - protein, 525 aa, Unknown
  Description of Unknown: uncultivated organism sequence
  Category: MG91 effectors
  Description: MG91-425 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGCKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKRKNYQRKVDRLREMHRVAAAERKCRHGQTINLLLSIAGDIRIEKNSWKAFQRGHFGKSLGKSAMSGFIAQLKSKAASAGLKVKEVNPYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETFPL

SEQ ID NO: 3234 - protein, 530 aa, Unknown
  Description of Unknown: uncultivated organism sequence
  Category: MG91 effectors
  Description: MG91-426 effector
MTSPSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDRLHEMHRVAAAQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKAAVEQLEGAKQLLTDAGYVVLKSTSSRDQRDPRLAPEPKAMTPEMARQKILRGAGDSHLPTDQALGRIRAGEKVSTWSKETFPLQRGVV

SEQ ID NO: 3235 - protein, 1047 aa, Unknown
  Description of Unknown: uncultivated organism sequence
  Category: MG91 effectors
  Description: MG91-427 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRKPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVCPTGKIGLLSSMFTNPDYRRKGIAKELLSRVVNDAREYGCGTVQITASDMGVKLYTDFGFVHNDNFMQYKI

SEQ ID NO: 3236 - protein, 412 aa, Unknown
  Description of Unknown: uncultivated organism sequence
  Category: MG91 effectors
  Description: MG91-428 effector
MIAKHRQRSGRKTELGINETQKIATRVFQAVNRYKLGLGGRPRFKSLSRGLRSIEGKSNKTGLKFNIEKSVLSWCKHDYCVFIDPQDDFLQRALRSEGRSGFKKVKYCRLVRKTIKGKNRFYLQVVLEGQAPIKHIYASTSERLSIDPGPQTIAVFSDVWAGKIKVSPSAQVDEKRLRCIQRSMDRSLRKSNPDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQLDVMSALLLQCADLEEEKHIPTEVIKTLEGVKQLLRDAGYVILKPSSNGESNPTFASEPKAVTPEKVRLEIFCGASDSYL

SEQ ID NO: 3237 - protein, 637 aa, Unknown
  Description of Unknown: uncultivated organism sequence
  Category: MG91 effectors
  Description: MG91-429 effector
MLTKELRQEALKKGLHYPKVENSVEFYITKNLMIYDFVNENRISMLRVCIAEKKAGIYDTFTKTWADCLLSSFLGKAGISVSERLAFALSAEAKKRLSSGQENFDYLALYKIDQQISYAKNWEKRHTADERKKEISQIMAGTNKRLSAGFTKFNHSLFGDCKRIMYSKSEKAVYCPECESISRISSPPKKGSLYRCPVCRFTAKVSQAENPLTEVHWSCIVQPAGKRSIIRYFCNDFSLQFGKCKIASEEKFRTILEADGSRIELMQTGNGWEDYKEKRYGLYNPSKRDVPYDMYLYGNVKAIQKISAYEHSMLDVWVKQHKNKKNELYTVYLIENYISQYAKNEIFEKLLKCGLNHIAHEAAFHNYNCTFNFNGNKIEDFLNIKMASLEQLRRIINDPFERDIIAMRYLDKNNLYLKDEELKKFLSLNVSNDMKEKIVRFCKFKKVTFYKVNKYVTENADWSSYFDYIGWTEELKYKKSDSVYYPKDFFKTHDRVFKELEEKKDAIQRKKDKEISKKIADLWEQRMQIPQYHYENNDLFVMMPHGTSDLKKEGRSLNHCVADYKEFVAEEKTQIFFIRKKAAPQKSFYTLEIKNHEIEQCHGRNNVDMTEGIRSFAYGFLKQLNTIKENPAVRAAA

SEQ ID NO: 3238 - protein, 497 aa, Unknown
  Description of Unknown: uncultivated organism sequence
  Category: MG91 effectors
  Description: MG91-430 effector
MPSPTFIIELPIRVSDSESRTILRKLEFARQLHNATLGTALGQLRQLRQDSEWKKACQMSKGKQRSELFRKLDRKYQLSEYDLHAVIANHRQSSGRKAELGINETQKIATRVFQAVNRYKLGLGGRPRFKSLSRGLRSIEGKSNKTGLKFNIEKSVLSWCKHDYRVFIDPRDDYVQRALHSEDRGGFKKIKYCRLVRKTIKGKNRFYLQVVLEGQAPIKHIYASTSERLSIDPGPQTIAVFTEVWAGKIKVSPTAQVDEKRLCCIQRSMDRSLRKSNPDCYESDGTLRKGCVLKKTKGYEKRIQRLQECHRKAAATRRCEHGQLINLLLSMAGDIRVEKNQWKAFQKGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNEESNPTFASEPKAVTPEKVRLEIFCGASDSYL

SEQ ID NO: 3239 - protein, 530 aa, Unknown
  Description of Unknown: uncultivated organism sequence
  Category: MG91 effectors
  Description: MG91-431 effector
MTSPSFVIELPIAVDDAEMRTIVRKLEFARQLHNATLGTAMGQLQQMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKEFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKITEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3240 - protein, 537 aa, Unknown
  Description of Unknown: uncultivated organism sequence
  Category: MG91 effectors
  Description: MG91-432 effector
MSTKSFIISLPIITGGQDRRRLRKSFSFGCNLQNAVMGGGWDRVLQMRATAEWQATRAMPKGRERTKAFRDLRVRFRLSEYDFHADVAKHRKASGRGHLLGINECQKLASRAWISVERHLYNGGAPRFISSRRGLHSIEGKTNRTGIIWKADQQCVTVCKHVYRVRVDKRDDWLTRALQDPTDPTKPRKVKYCRIVREMRKGKERFFLQLVAEGSSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADIENQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3241 - protein, 537 aa, Unknown
  Description of Unknown: uncultivated organism sequence
  Category: MG91 effectors
  Description: MG91-433 effector
MSTKSFIISLPIITGGQDRRRLRKSFSFGCNLQNAVMGGGWDCVLKMRATPEWQAARAMPKGSERTKAFRDLRMRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPKKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYEKLRSELAEMLRLCAATRKREHGEVCNWLLGHAGHIIVEDNSYKAFQRGRFGKTIGRHAPAALYAQLTNKAESAGLLVEVVSPKKLKPSQHNLLTDTFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3242 - protein, 497 aa, Unknown
  Description of Unknown: uncultivated organism sequence
  Category: MG91 effectors
  Description: MG91-434 effector
MTSPTFIIELPIRVSDSESRTILRKLEFARQLHNATLGTALGQLQQLRQDSEWDKACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDYLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNTDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3243 - protein, 525 aa, Unknown
  Description of Unknown: uncultivated organism sequence
  Category: MG91 effectors
  Description: MG91-435 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDQYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVVAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWAKETFPL

SEQ ID NO: 3244 - protein, 530 aa, Unknown
  Description of Unknown: uncultivated organism sequence
  Category: MG91 effectors
  Description: MG91-436 effector
MTSPSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDQLHEMHRVAAVQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCANIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3245 - protein, 530 aa, Unknown
  Description of Unknown: uncultivated organism sequence
  Category: MG91 effectors
  Description: MG91-437 effector
MTSPSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDRLHEMHRVAAAQRKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGQYIQRDVLSALLLYCADIEKEIHIPKVAVEQLEGAKQFLTDAGYVVLKSTSSRDQRDPRLAPEPKAMTPEMARQKILRGAGDSHLPTDQELGRIRAGGKVSTWSKETFPLQRGVV

SEQ ID NO: 3246 - protein, 538 aa, Unknown
  Description of Unknown: uncultivated organism sequence
  Category: MG91 effectors
  Description: MG91-438 effector
MTTQTFILELPIKADDSQSRTISKKFEYGRMLYNATLGSGLGRLTQMRQDPEWRCACEMSKGKERNELFRRLNRQYRLTEYDFHSDIARHREGTKRKSELGICEAQKLATQAFNAVSRYMFKQGGRPRFKSFKRGLHSLEGKTNTTGLKFKPEKMLLDWCRKTYQVMLDPEDTYALEALYADKERTKFKRIKYNRIVCRNIKGVKRFYLQVVLEGTPPVKHAYAPASERMAIDPGPKAFAVFCPRVQAKVQIAPQAKVNEKAIRRIQRSMDRSLRAKNPNAFDEKGRIKPGVSLAYSKGYQARLTKLREAHRKVAGTRKCEHGELANLLLECAGNIRIEKNSWEAFKRSHFGRSINNSAASGFIQKLKSKAERAGLTVEEVSPYRLKPSQYDPYKDEFVKKALGERWMYLGDESTVIQRDIMSAILIYFADLKNQTHNPEVVKTNLEGLKRGLTDAGYVKHLKLPRSSGSKDPLFAPEPKALTTEELRSKCFRVDSDRHSSTINGTDGKAVGWSETFPLTGELFRDSVLSSVSARGAS

SEQ ID NO: 3247 - protein, 537 aa, Unknown
  Description of Unknown: uncultivated organism sequence
  Category: MG91 effectors
  Description: MG91-439 effector
MSTKSFIINLPIITGDQDRRRLRKSFSFGCNLQNAVMGGGWDRVLKMRATPEWQTARAMPKGSERTKAFRDLRVRFRLNEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYEAVDVVRHGKKKKSFKVKSGRLQWRFSKRYEKLRSELAEMLRLCAATRKREHGEVCNWLLGHAGSIIVEDNSFKAFQKGHFGKSIGRHAPAAFYTQLTSKAESAGLQVTVVSPRKLKPSQHNLLTDTFVKHELWERRVRLGNDDDDRWIDRDAAACLNLLYADLEKQTYAPERIREAVLAGVTAWLDAGVVVIQAREGYTEREFGRFRRRGIPSLTVQGLRQQGFRGRSDSKSGATPRRKASTVSKPSHFSGEVV

SEQ ID NO: 3248 - protein, 639 aa, Unknown
  Description of Unknown: uncultivated organism sequence
  Category: MG91 effectors
  Description: MG91-440 effector
MLTKELRQEALKKGFHYPKVEKSVEFYRTKNLMIYDFVNENRISMLRVCIAEKKAGIYDTFTKTWADCLLSSFLGKAGISVSELLAFALSAEAKKRLSSGHDNFDYLALYKIDQQISYAKNWEKRHPADERKKEISQIMAGTNKRLSAGFIKFNLDLFGDCKRIMYSKSEKAVYCPECESISRISSPPKKGSLYRCPVCCFTAKVSQAENPLTEVHWSCIVQPAGKRSIIRYFCNDFSLQFGKCKIASEEKFRTILEAGGSRIELMQTGNGWEDYKEKRYGLYYPSKRDVPYDMFLYGNVKAILKIPVYEHSMLDVWVKQHKNKKNELYTVYLIENYISQYAKNEIFEKLLKFGLNHIAHEAAFHNYNRTFNFNGNKIEDFLNIKMASLKQLRRIINDPFERDIIAMRYLDKNNLYLKDEELKKFLSLNVSNDMKEKIVRFCKFKKVTFYKVNNYVTENANADWSSYFDYIGWTEELEYKKSDSVYYPKKFFKTHDRVFKELEEKKDAIQRKKDKEISKKIAGLWEQRMQIPQYHYENNDLFVMMPHGTSDLKKEGRSLNHCVADYKEFVAEEKTQIFFIRKKAAPQKSFYTLEIKNHEIEQCHGRNNVDMTEEIRSFAYGYLKQLNTLNEKAAVKAVA

SEQ ID NO: 3249 - protein, 525 aa, Unknown
  Description of Unknown: uncultivated organism sequence
  Category: MG91 effectors
  Description: MG91-441 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSSNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVDPYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETFPL

SEQ ID NO: 3250 - protein, 633 aa, Unknown
  Description of Unknown: uncultivated organism sequence
  Category: MG91 effectors
  Description: MG91-442 effector
MLTKELRQEALKKGFHYPKVEKSVEFYRTKNLMIYDFVCEESAVVRVCISKQHAGIYDVLNNIWKDCTLENYLEDPNQFTNYILSERAKKLLKTDSLFFDSKASFAIDAQIRKAKNWKKINQKENREKEIKKIMAGTNKPVPSGFKIFSEKLLCSAKRIMYSAKEKSLYCPECGNTFQLPDVPKKGSLHTCPACGYSTKVSSAQYLNDIHWSCIVQAAGKRSIIRYFCNELFIEYGKCSTILYEKYRTIVEEDGSMVPLMQTSEGWKDYKGKNYSYFYTVPKREVPNDMYLYGTVEALMKMPALKNSMLDVWVKQHIGADKKLCSEYLVENYIKVYAQTTIYEKLLKHGLNKIAHEAAFYYDSSFHKNEEKVDKFLNLTKGNLDRLREFIPDPSGSNVSAMRYLEKYNVYLKDDELKTFLRLEVSDNMKEQIVKFCKCKKVTLYKINKYVTENANADWSSYFDYIGWTEELDYKKSDSVYYPKKFFKTHDRVFKELEEKKDAIQRKKDKEISKKIADLWEQRMQIPQYHYENNDLFVMMPHGTSDLKKEGRSLNHCVAGYKEFVAEEKTQIFFIRKKAAPQKSFYTLEIKNHDIEQCHGKNNVNMTEEIRAFAYGFLNQLKTIKEKPAVRAAA

SEQ ID NO: 3251 - protein, 525 aa, Unknown
  Description of Unknown: uncultivated organism sequence
  Category: MG91 effectors
  Description: MG91-443 effector
MTSQSFVIELQIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLVDPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVKEVNPYKLKLSQYDPYTDTYRKKDLSERWQEMKAGSGQYIQRDVLSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETCPL

SEQ ID NO: 3252 - protein, 634 aa, Unknown
  Description of Unknown: uncultivated organism sequence
  Category: MG91 effectors
  Description: MG91-444 effector
MLTKDLKQEALKRGFLHSGVNDSIEAYRTRNLTIYDFVCEESAVVRVCISKQHAGIYDVLSNIWKDCMLENYLEDPNQFANYMLSECAKKLLKTDSLFFDSKASFAIDAQIRKAKNWKKINQKENREKEIKKIMAGTNKPVPSGFKIFSEKLLCSAKRIMYSAKEKSLYCPECGNTFQLPDVPKKGSVHTCPACGYRAKVSCVQYQLNDIHWSCIVQAAGKRSVIRYFCNELLLEYGKCSTIFYEKYRTIIEEDGSMVPLMQTSEGWNDYKAKNYSFFYTVPKREVPNDMYLYGTVDALMKMPVLKNSMLDVWVKQHIGADKKLCSEYLVENYIKIYAKTTIYEKLLKCGLNKIAHEAAFYYGSSFHMDEKKIDKFLNLTKGNLNRLREFIPDPSGSNVSAMRYLEKYNVYLKDDELKTFLRLEVSDNMKEQIVKFCKCKKVTLYKINKYVTENANADWSSYFDYIGWTEELDYKKSDSVYYPKKFFKTHDRVFKELEEKKDAIQRKKDKEISKKIAGLWEQRMQIPQYHYEDSQFIVIMPHGTSDLKKEGKSLNHCVVSYKEYVAEKSTQIFFIRKKTDPHKSFYTLEIKNHEIAQCHGKNNVDMTEEIRAFAYGFLNQLNTIKEKPAVRAAA

SEQ ID NO: 3253 - protein, 489 aa, Unknown
  Description of Unknown: uncultivated organism sequence
  Category: MG91 effectors
  Description: MG91-445 effector
MLYNATLGSGLGRLTQMRQDPEWRRALGMVKGKERNELFRRLNRQYRLTEFDFHADIARHREGTKRKSELGINEAQKLATQAFNAVSRYMFKQGGRPRFKSFKRGLHSIEGKTNKTGLKFKPDQMILDWCRKTYQVMLDPKDAYALDALYADKERTQFKRIKYNRIVCRNIKGVKRFYLQVVLEGTPPVKHAYAPASERMAIDPGPKAFAVFCPRVQAKVQVAPRAKVNEKAIRRIQRSMDRSLRATNPNAFDEKGRIKPGVSLAYSKGYQVHLTNLREAHRKAAGTRKCEHGELANLLLECAGNIRIEKNSWEAFKRSHFGRSINNSAASGFIQRLKSKAERAGLTVEEISPFRLKPSQYDPYKDEFVKKALGERWMYLGDESTVIQRDIMSAILIYFADLKNQTHNPEVVKASLEGLKRGLTDAGYVKHLKLPRSSGSKDPLFAPEPKALTTEELRSKCFRVASNSHSSTLNGTDGKAVGWSETFWL

SEQ ID NO: 3254 - protein, 525 aa, Unknown
  Description of Unknown: uncultivated organism sequence
  Category: MG91 effectors
  Description: MG91-446 effector
MTSQSFVIELQIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRFKLGLGGMPRFKSSKRGLHSIEGKTNKTGLKFRPEKKVLNWCGHDYRVLIDPKDDYIQRALKENERSDQYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLAPEPKAMTPEMARQKILRGAGDSHLPTDQALGRIRAGEKVSTWSKETFPL

SEQ ID NO: 3255 - protein, 525 aa, Unknown
  Description of Unknown: uncultivated organism sequence
  Category: MG91 effectors
  Description: MG91-447 effector
MTSQSFVIELQIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDQYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLAPEPKAMTPEMARQKILRGAGDSHLPTDQALGRIRAGEKVSTWSKETFPL

SEQ ID NO: 3256 - protein, 525 aa, Unknown
  Description of Unknown: uncultivated organism sequence
  Category: MG91 effectors
  Description: MG91-448 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGPNNFNEAASRRLLRAMDRSLKRNNPDAYNEDGTIKKGAKLVKSKNYQRKVDRLREMHRVSAAERRCLHGQTINLLLSIAGDIRIEKNSWKAFQRGHFGKSLGKSAMSGFIAQLKSKAESAGLKVTEVNPYKLKLSQYDPYTDTYRKKALSERWQEMKAGSGQYIQRDVLSALLLYCADIEKEIHIPKAAVEQLEGAKQLLTDAGYVVLKSTSSRDQRDPRLAPEPKAMTPEMARQKILRGAGDSHLPTDQALGRIRAGEKVSTWSKETFPL

SEQ ID NO: 3257 - protein, 537 aa, Unknown
  Description of Unknown: uncultivated organism sequence
  Category: MG91 effectors
  Description: MG91-449 effector
MSTKSFIISLPIITGDQDRRRLRKSFSFGCNLQNAVMGGGWDRVLQMRATPEWQATRAMPKGRERTKAFRDLRVRFRLSEYDFHADVAMHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGSIIVEDNSFKAFQKGHFGKSIGRHAPAAFYTQLTSKAESAGLQVTVVSPRKLKPSQHNLLTDTFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGTTPRRKASTVSKPSHFSGEVV

SEQ ID NO: 3258 - protein, 530 aa, Unknown
  Description of Unknown: uncultivated organism sequence
  Category: MG91 effectors
  Description: MG91-450 effector
MTYQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDQYRKIKYCRLVRKRIRSADRFFLQVVLEGTAPVKHVYSPVTERAAIDPGPQSIALFSKAFAGKIQVAGSNNFNEAASRRLLRAMDRSLRRNNPDAYNEDGTINKGAKLAKSKNYQRKVDQLHEMHRVAAAQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3259 - protein, 537 aa, Unknown
  Description of Unknown: uncultivated organism sequence
  Category: MG91 effectors
  Description: MG91-451 effector
MSTKSFIISLPIITGDQDRRRLRKSFSFGCNLQNAVMGGGWDRVLQMRATPEWQATRAMPKGRERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGHIIVEDNSYKAFQRGRFGKTIGRHAPAAFYTQLTSKAESAGLQVTVVSPRKLKPSQHNLLTDTFVKHELWERRVRLGNDDDDRWIDRDAAACLNLLYADLEKQTYAPERIREAVLAGVTAWLDAGVVVIQAREGITEREFGRFRRRGIPSSTVQGLRQQGFRGRSDSKSGATPRRKASTVSKPSHFSGEVV

SEQ ID NO: 3260 - protein, 514 aa, Unknown
  Description of Unknown: uncultivated organism sequence
  Category: MG91 effectors
  Description: MG91-452 effector
MRAKNSKDDVNSAVMTTPTFVLELPVKLGQGELAEVRKRFNYARNLYNATVGTALGQLQQMRQDPQWRQACSMSKGKERTTTFRRLDEKYRLREYDLHAIIAKHREASGRKHDLGINEAQKLATRVYEVVTKYKLGLGGKPRFKTQSRGLHSISGKTNKTGLRFKPEKSRLYWNSLEMFVEIDRKDRYIFEALHVDNDPSRFKRIKYCSLVRKVINGKERYYLQLSLEGQAPIKHIYAPQTERLAIDPAPKAITVFHKEKVFKASIEVSVHAEKQKKLQKQMSRSLQLNNPDAFDENGTLKKGARLQVKSKSYLKKQTKLCEVYRRAAAARKNLHGQVSNLLLSLAGEIVLEKNSWKALQRGHFGKSLGKSGMGAFERTLISKAERAGCKVHLVAPYILKPSQYDPFKDAFEKIPLKQRWRRMDDKELIQRDMLSAVLLYCADLANERHNRTEIFQTLEGAKQLLSDGGFVVKENPTSNPALDPRFAPERKAQAIEEVRREILCGCKGQLNANR

SEQ ID NO: 3261 - protein, 497 aa, Unknown
  Description of Unknown: uncultivated organism sequence
  Category: MG91 effectors
  Description: MG91-453 effector
MTSPTFIIELPIRVSDSESRTILRKLEFARQLHNATLGTALGQLQQLRQDSEWEKACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDYLQRALRSEDRGGFKKIKYCRLVRKTIKGKNRFYLQVVLEGQAPIKHVYASSSERLSIDPGPQTIAVFSEVWAGKIKVSPTAQVDEKRLRCIQRSMDRSLRKSNPDCYESDGTLKKGCVLKKTKGYEKRIQRLQECHRKAAATRRCEHGQLINLLLSMAGDIRVEKNQWKAFQRGHFGKSLGKSGISGFIERLKSKAESAGLKVTEVRPYKLKLSQYDPYTDQYRKKSLNERWHSLGEGSEWIQRDVMSALLLQCADLEEEKHIPTEVIKTLEGVKQFLRDAGYVILKPSSNGESNPAFASEPKAVTPEKVRLEIFCGASDSYL

SEQ ID NO: 3262 - protein, 530 aa, Unknown
  Description of Unknown: uncultivated organism sequence
  Category: MG91 effectors
  Description: MG91-454 effector
MTSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPGKKVLNWCGHDYRVLIDPKDDYIQRALKENERSDQYRKIKYCRLVRKRIRSADRFFLQVVLEGTAPVKHVYAPVTERAAIDPGPQSIALFSKAFAGKIQVAGSNNFNEAASRRLLRAMDRSLRRHNPDAYNEDGTINKGAKLAKSKNYQRKVDQLHEMHRVAAAQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3263 - protein, 497 aa, Unknown
  Description of Unknown: uncultivated organism sequence
  Category: MG91 effectors
  Description: MG91-455 effector
MTSPTFIIELPIRVSDSESRTILRKLEFARQLHNATLGTALGQLQQLRQDSEWEKACLMPKGKERSELFRKLDRKYQLTEYDLHAVIAKHRRASGRKAELGINETQKIATRVFQAVNRYKLGLGGRPRFKSLSRGLRSIEGKSNKTGLKFNIEKFVLSWCKHDYRVFIDPQDDYLQRALRSEGRSGFKKVKYCRLVRKIIKGKNRFYLQVVLEGKAPIKHIYASTNERLSIDPGPQTIAVFSNVWTGKIKVSPNAQIDEKKIRRIQRSMDRSLRKSNPDCYESDGTLKKGCVLKKTKGYEKRIQRLQECHRKAAATRRCEHGQLINLLLSMAGDIRVEKNQWKAFQRGHFGKSLGKSGISGFIERLKSKAESAGLKVTEVRPYKLKLSQYDPYTDQYRKKSLNERWHSLGEGSEWIQRDVMSALLLQCADLEEEKHIPTEVIKTLEGVKQFLRDAGYVILKPSSNGESNPAFASEPKAVTPEKVRLEIFCGTSDSYL

SEQ ID NO: 3264 - protein, 498 aa, Unknown
  Description of Unknown: uncultivated organism sequence
  Category: MG91 effectors
  Description: MG91-456 effector
MSGPTFIIELPIRVSDSESQTILRKLEFARQLHNATLGSALGQLQQLRQDSDWKKACSMPKGKERTSLFKLLDRKYHLTEYDLHAVIAKHRQASGRKTELGINEAQKIATRVFQAVNRYKLGLGGRPRFKSAKRGLRSIEGKTNKTGLKFNIEKSVLSWCKHDYRVIINPKDDYIRRAFLKEDGSKGFKTIKYCRLVRKTIKGKNRFYLQVVLEGYAPVKHIYASTEERLSIDPGPQTIAVFSKMWSGKIKVAPHAQVDEQRIRNLQRSMDRSLRQNNPDCYERNGVFKKGSELSRTKSYEKRVQNLKEYHRKASATRRCEHGQLINLLLSVAGEIRIEKNSWKAFQRGHFGKSLGKSGISGFIEQLKSKAESASLKVVEVKPYKLKLSQYDPYTETYEKKALNERWHRLGRSSEWIQRDVMSALLLQCADIENDKHIPTEVIKTLEGAKQLLRDAGYVILKPSSNGDNCQPFASEPKAVTPEKVRLEIFCGTDDSHL

SEQ ID NO: 3265 - protein, 537 aa, Unknown
  Description of Unknown: uncultivated organism sequence
  Category: MG91 effectors
  Description: MG91-457 effector
MSTKSFIISLPIITGGQDRRRLRKSFSFGCNLQNAVMGGGWDRVLQMRATAEWQATRAMPKGRERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFFLQLVAEGSSPLKHAYAGKDLRMAIDPGLGSLTYATEDGTIAKVQIAPSADTDHRAVRKLQRAMERSRQATNPDNYEAVDVVRHGKKKKSFKVKSGRLQWRFSKRYKSLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADIENQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3266 - protein, 530 aa, Unknown
  Description of Unknown: uncultivated organism sequence
  Category: MG91 effectors
  Description: MG91-458 effector
MTSLSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLINPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLPALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3267 - protein, 352 aa, Unknown
  Description of Unknown: uncultivated organism sequence
  Category: MG91 effectors
  Description: MG91-459 effector
MSKKTVSARVNTNIPAEVPQDVRPRFLSVQNYRLLLAVTRFSTDYAQGVVRINNMQEMNCQELKTPEVLESTACQGECKKKFTRNNAKSLFCVVDKSVDLDDVARRWSKFRFMCKDCSDQYIFTEPYHVVQLYPSVGLDNIKVLCDEGFITKYVFPIKLECTEVVTQTEVPNYHDFYKVVKSIVKDKKPHEQITKLQLLTYGRVLFTETDYDCVMKSTVDPYGEMATELEFYPQHSSMMAFLPTYKDTKPLTYIYRVVKQVYSSNYDNYVVYFPIKCTLYCKLCKDNKIYLKVHPVLYCSQCGFTDALFFRKSTVMANTMFFKECVKSKTQKPRRIIYYDMVLYKTMVKKLK

SEQ ID NO: 3268 - protein, 376 aa, Unknown
  Description of Unknown: uncultivated organism sequence
  Category: MG91 effectors
  Description: MG91-460 effector
MMKKVTTTTTTSAAIKKKVSAKVNTNREDDSLKDLRGRFLSNQNYQLMKYVLRFATAYAQGTLRVNDLKEMNCDDLKYGEVTTSACCQGECGKKFNGAKILFCVIDSEDGAGDIEDKFKLVCHFCSNDYSYQKRYEVMQLYPTVSLPVVERLCEVGFITKYIFPIELDYTVTTTRTEVCNFHNFYKMVKSIIREKKSNEHITEIRLSTYGRDLFVETDDNCIMKNGINEYSEHFYELDFPSSPSTMLPFVQTYKETKLLTYFYTVTKRVYYSFFDYVVHFPIKCTRFCKLCKEDKLYLKTHPVLYCSKCGFTDAAFFKNAPFLKTTVFLAKCVKAKTLSPTRIYYYDMNEYKSYINKPPPSAAGAKNAGKKTNKKK

SEQ ID NO: 3269 - protein, 388 aa, Unknown
  Description of Unknown: uncultivated organism sequence
  Category: MG91 effectors
  Description: MG91-461 effector
MKKTTTTTVISSSKKKVSAKVNTNRRDDDDSKFKDLRGRFLSNQNFQLMKYVLRFATNYVQGTYFVNDLKEMECTDLKYGEVERRTVCQGGCGKKFTGGNKLLFCVIDNNGTDVDDEQYEKFKVVCHVCSNDYAYKRRYEVMQLFPTVSLSVVERLCEVGFITKYIFPIDLEYTVTETRTEVCNYHNFYKMVKSIIREKKTNEHITEIKLSTYGRDLFIETDENCAMRNGQNEYNEHVYELEFHPSPSTMIPFVQTYAEKKPLTYFYTVTKRVYLSFFDYAVCFPIKCINYCKMCKQDKLYFKINPVLYCSKCGFTDASFFKNAPFLKNTVFLAKCVKAKTLPPTRIYYYDMNLYKSYMNKASLSSSPTASKNKLFDFKPKALKFGKI

SEQ ID NO: 3270 - protein, 388 aa, Unknown
  Description of Unknown: uncultivated organism sequence
  Category: MG91 effectors
  Description: MG91-462 effector
MKKTTTTTVISSSKKKVSAKVNTNRRDDDDSKFKDLRGRFLSNQNFQLMKYVLRFATNYVQGTYFVNDLKEMECTDLKYGEVERRTVCQGGCGKKFTGGNKLLFCVIDNNGDDVDDGQYEKFKVVCHVCSNDYAYKRRYEVMQLFPTVSLSVVERLCEVGFITKYIFPIDLEYTVTETRTEVCNYHNFYKMVKSIIREKKTNEHITEIKLSTYGRDLFIETDENCAMRNGQNEYNEHVYELEFHPSPSTMIPFVQTYAEKKPLTYFYTVTKRVYLSFFDYAVCFPIKCINYCKMCKQDKLYFKINPVLYCSKCGFTDASFFKNAPFLKNTVFLAKCVKAKTLPPTRIYYYDMNLYKSYMNKASLSSSPTASKNKLFDFKPKALKFGKI

SEQ ID NO: 3271 - protein, 389 aa, Unknown
  Description of Unknown: uncultivated organism sequence
  Category: MG91 effectors
  Description: MG91-463 effector
MKKTTTTTVISSSKKKVSAKVNTNRDDDDSKFKDLRGRFLSNQNFQLMKYVLRFATNYVQGTYLVNDLKEMECTDLKYGEVERRTVCQGGCGKKFTGGNKLLFCVIDNNGDDDDVDDGGNEKFKVVCHVCSNDYAYKRRYEVMQLFPTVSLSVVERLCEVGFITKYIFPIDLEYTVTETRTEVCNYHNFYKMVKSIIREKKTNEHITEIKLSTYGRDLFIETDDNCAMRNGQNEYNEHVYELEFHPSPSTMIPFVQTYAEKKPLTYFYTVTKRVYLSFFDYAVCFPIKCINYCKMCKQDKLYFKINPVLYCSKCGFTDASFFKNAPFLKNTVFLAKCVKAKTLPPTRIYYYDMNLYKSYMNKASLSSSPTASKNKLFDFKPKALKFGKI

SEQ ID NO: 3272 - protein, 353 aa, Unknown
  Description of Unknown: uncultivated organism sequence
  Category: MG91 effectors
  Description: MG91-464 effector
MKKSVSIKVPAKVNTNIGDEKPKDLRNRFLSTQNYRLLSAVSRFATDYVQGVLRVNDLVEMKCNELKGQDLVDSAVCQGECRKKFSKGAKYLFCVVDSAADVNDVTQRWNKFKLVCNTCSNDYAFNAQYEVMQLYPTVSLADVERMCEVGFLTKYIFPIKLEYTESRTETEVPGYHNFYKIVKSIVKDKKHNEQISKIQLCTYGRDLFTETDYDCAMKSGVDAYGDMTFELEFYPRDSNMMAFLETYKDTKPLTYFYRVTKRIYSSRFDYVVYFPIKCTRYCKFCKASKIYAKNNPVLYCSQCGFTDAMFFKNSPLLSSVTFYDECVKSKTLKPKRIFYYDMALYKTMSKKLK

SEQ ID NO: 3273 - protein, 497 aa, Unknown
  Description of Unknown: uncultivated organism sequence
  Category: MG91 effectors
  Description: MG91-465 effector
MTSPTFIIELPIRVSDSESRTILRKLEFARQLHNATLGTALGQLQQLRQDSEWEKACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNPDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3274 - protein, 497 aa, Unknown
  Description of Unknown: uncultivated organism sequence
  Category: MG91 effectors
  Description: MG91-466 effector
MPSPTFIIELPIRVSDSESRTILRKLEFARQLHNATLGTALGKLQQLRQDSEWKRACLMPKGKERSELFRKLDRKYQLSEYDLHAVIANHRQSSGRKAELGINETQKIATRVFQAVNRYKLGLGGRPRFKSLSRGLRSIEGKSNKTGLKFNIEKSVLSWCKHDYRVFIDPQDDYLQRALRSEGRSGFKKVKYCRLVRKTIKGKNRFYLQVVLEGQAPIKHIYASTNERLSIDPGPQTIAVFSNVWAGKIKVSPNAQIDEKKIRRIQRSMDRSLRKSNPDCYESDGTLKKDCVLKKTKGCEKRIQRLQECHRKVAATRQCEHGELINLLLSVAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGAKQLLRDAGYVILKPSSNGESNPTFASEPKAVTPEKVRLEIFCGTSDSYL

SEQ ID NO: 3275 - protein, 530 aa, Unknown
  Description of Unknown: uncultivated organism sequence
  Category: MG91 effectors
  Description: MG91-467 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAVSNNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVTPYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETFPLQRGVV

SEQ ID NO: 3276 - protein, 349 aa, Unknown
  Description of Unknown: uncultivated organism sequence
  Category: MG91 effectors
  Description: MG91-468 effector
MKKSAIAKVNTNKSDESPKDLRSRFLSTQNYRLLSAVSRFATDYVQGILRVNDLAEMRCQELKGRELLESTSCQGECRKKFSKSAKYLYCIIDSAVNVNDPSQRWNKFKFVCNSCSNDFAFNAQYEVIQLFPTVSLEDVERLCAVGFLTKYIFPIKLEYTESKTETEVPNYHNFYKIVRSIVKDKKHNEQIIKIQLSTYGRDLFIETDHNCTMRSGVDAYGDVTFDLEFYPRDSNMMSFLSTYKDTKPLTYFYRVTKRIYTSRFDYVVYFPIKCTRYCKLCKDSKIYMKTNPVLYCSQCGFTDAMFFQNSIMLSSVMFIDECVKSKTLKPKRIFYYDMALYKNIIKKLK

SEQ ID NO: 3277 - protein, 530 aa, Unknown
  Description of Unknown: uncultivated organism sequence
  Category: MG91 effectors
  Description: MG91-469 effector
MTSQSFVIELPIAVDDAEMRTIVRKLEFARQLHNATLGTALGQLQQMRQDTAWKQACAMPKGKERAAAFRALDRKYGLTEYDLHSVIARHREGTSRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETFPLQRGVV

SEQ ID NO: 3278 - protein, 537 aa, Unknown
  Description of Unknown: uncultivated organism sequence
  Category: MG91 effectors
  Description: MG91-470 effector
MSTKSFIISLPIITGGQDRRRLRKSFSFGCNLQNAVMGGGWDCVLKMRATPEWQAARAMPKGSERTKAFRDLRMRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPKKPRKVKYCRIVREMRKGKECYFLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRSENLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADIENQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3279 - protein, 537 aa, Unknown
  Description of Unknown: uncultivated organism sequence
  Category: MG91 effectors
  Description: MG91-471 effector
MSTKSFIISLPIITGDQDRRRLRKSFSFGCNLQNAVMGGGWDRVLKMRATAEWQTARAMPKSSERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKCDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADIENQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3280 - protein, 530 aa, Unknown
  Description of Unknown: uncultivated organism sequence
  Category: MG91 effectors
  Description: MG91-472 effector
MPSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFWQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMSRQKILRGAGDSHLPTDQALGRIRAGGKVSTWSKETFPLQRGVV

SEQ ID NO: 3281 - protein, 497 aa, Unknown
  Description of Unknown: uncultivated organism sequence
  Category: MG91 effectors
  Description: MG91-473 effector
MTSPTFIIELPICVSDSESRTILRKLEFARQLHNATLGTALGQLQQLRQDSEWEKACLMPKGKERSELFIKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDYLQRALRSEGRSGFKKVKYCRLVRKTIKGKNRFYLQVVLEGQAPIKHIYASTNERLSIDPGPQTIAVFSDVWAGKIKVSPTAQVDEKRLRCIQRSMDRSLRKSNPDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3282 - protein, 583 aa, Unknown
  Description of Unknown: uncultivated organism sequence
  Category: MG91 effectors
  Description: MG91-474 effector
MLTKDLKQEALKRGFLHSGVNDSIEAYRTRNLTIYDFVCEESAVVRVCISKQHAGIYDVLSNIWKDCMLENYLEDPNQFANYMLSECAKKLLKTDSLFFDSKASFAIDAQIRKAKNWKKINQKENREKEIKKIMAGTNKPVPSGFKIFSEKLLCSAKRIMYSAKEKSLYCPECGNTFQLPDVPKKGSLHTCPACGYSTKVSSAQYLNDIHWSCIVQAAGKRSIIRYFCNELFIEYGKCSTILYEKYRTIVEEDGSMVPLMQTSEGWKDYKGKNYSYFYTVPKREVPNDMYLYGTVEALMKMPALKNSMLDVWVKQHIGADKKLCSEYLVENYIKVYAQTTIYEKLLKHGLNKIAHEAAFYYDSSFHKNEEKVDKFLNLTKGNLDRLREFIPDPSGSNVSAMRYLEKYNVYLKDDELKTFLRLEVSDNMKEQIVKFCKCKKVTLCKINKYVTENANADWSSYFDYIGWTEELDYKKSDSVYYPKKFFKTHDRVFKELEEKKDAIQRKKDKEISKKIADLWEQRMQIPQYHYENNDLFVMMPHGTSDLKKEGRSLNHCVAGYKEFVAEEKTQIFFKQLRKNRSIH

SEQ ID NO: 3283 - protein, 537 aa, Unknown
  Description of Unknown: uncultivated organism sequence
  Category: MG91 effectors
  Description: MG91-475 effector
MSTKSFIISLPIITGDQDRRRLRKSFSFGCNLQNAVMGGGWDRVLKMRATPEWQTARAMPKSSERTKAFRDLRVRFRLSEYDFHADVAMHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYEKLRSELAEMLRLCAATRKREHGEVCNWLLGHAGHIIVEDNSYKAFQRGRFGKTIGRHAPAALYAQLTNKAESAGLLVEVVSPKKLKPSQHNLLTDTFVKHELWERRVRLGNDDDDRWIDRDAAACLNLLYADLEKQTYAPERIREAVPAGVTAWLDAGVVVIQAREGITEREFGRFRRRGIPSLTVQGLRQQGFRGRSDSKSGTTPRRKASTESKPSHFSGEVV

SEQ ID NO: 3284 - protein, 530 aa, Unknown
  Description of Unknown: uncultivated organism sequence
  Category: MG91 effectors
  Description: MG91-476 effector
MTSQSFVIELPIAVDDAEMRTIVRKLEFARQLHNATLGTAMGQLQQMRQDAAWKEACVMPKGKERAAAFRALDRKYGLTEYDLHSVIAGHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQFLTDAGYVVLKSTSSRDQRDPRLASEPKAMTPEMARQKIFRGAGDSHLPTDQELGQIRAGGKVSTWSKETFPLQRGVV

SEQ ID NO: 3285 - protein, 525 aa, Unknown
  Description of Unknown: uncultivated organism sequence
  Category: MG91 effectors
  Description: MG91-477 effector
MTSQSFVIELPIALDDAEMRTIVRKLEFARQLHNATLGTAMGQLQQMRQDAAWKEACVMPKGKERAAAFRALDRKYGLTEYDLHSVIARHREGTGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRSNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVKEVNPYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETFPL

SEQ ID NO: 3286 - protein, 530 aa, Unknown
  Description of Unknown: uncultivated organism sequence
  Category: MG91 effectors
  Description: MG91-478 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKLGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNEDGTINKGAKLAKSKNYQRKVDQLHEMHRVAAAQRKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3287 - protein, 511 aa, Unknown
  Description of Unknown: uncultivated organism sequence
  Category: MG91 effectors
  Description: MG91-479 effector
MKKKSTNENFIMELPLTVEKFQYNELDKRFELMRRIYNTAQNKLKRQYEYLSSFKAYKDCKTKKEKGDFLESHPFSFKGILNKKGEPLKITFREYDLKSYLSQFTKEKVDSQYTYSDFGINSHMLMHMGMAIWSSWKKVLYDPKAQEVSFKKYGELQSIGVDWKQKKQYGMFLDLGKGIIKLNINGRQKSQARYLTMKIKFGHKERQVWYEGDALKAGEDSIKALTIVRRKIRDKYNYFLQMTIRNNKPQKGRTLGTGRVAIDLGTCKVAVVTKDSVRLIPLAPSISSYSKELRVIQRQMERSRRANNPKKYHKDGTVKKDNRDKWVTSKEYIRLRDIKAELERKQAAVRKQDHIALANELLSLGNEFVIEDNDVQEWAKRKKEEKKREKDGKNLSKAGLGKQIGNHSPATFVTILKNKVESLGGSFTEVDTDNGATDYDFINNEFTRHELEERYITLSDGKRHQRDTLAAFNLYHIDTTQNRVYDRLAMQRHYAWFCEKETEAVKKYKRL

SEQ ID NO: 3288 - protein, 537 aa, Unknown
  Description of Unknown: uncultivated organism sequence
  Category: MG91 effectors
  Description: MG91-480 effector
MSTKSFIISLPIITGGQDRRRLRKSFSFGCNLQNAVMGGGWDRVLQMRATAEWQATRAMPKGRERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPKKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADIENQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3289 - protein, 530 aa, Unknown
  Description of Unknown: uncultivated organism sequence
  Category: MG91 effectors
  Description: MG91-481 effector
MTSPSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKEFAGKIQVAGSNNFNEAVSRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCANIEKEIHIPKVAVEQLEGAKQFLTDAGYVVLKSTSSRDQRDPRLASEPKAMTPEMARQKIFRGAGDSHLPTDQELGQIRAGGKVSTWSKETFPLQRGVV

SEQ ID NO: 3290 - protein, 1352 aa, Unknown
  Description of Unknown: uncultivated organism sequence
  Category: MG91 effectors
  Description: MG91-482 effector
MTAFKYYLGLDMGTNSVGWAATDPEYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNVYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIPKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3291 - protein, 530 aa, Unknown
  Description of Unknown: uncultivated organism sequence
  Category: MG91 effectors
  Description: MG91-483 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDQLHEMHRVAAVQRKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGLYIQRDILSALLLYCADIEKEIHIPKVAVEQLEGAKQFLTDAGYVVLKSTSSRDQRDPRLASEPKAMTPEMARQKILRGAGDSHLPTDQELGRIRAGGKVSTWSKETFPLQRGVV

SEQ ID NO: 3292 - protein, 525 aa, Unknown
  Description of Unknown: uncultivated organism sequence
  Category: MG91 effectors
  Description: MG91-484 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSSNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAEYVVLKSTSSRDQRDLRLAPEPKAMTPEMARQKILRGAGDSHLPTDQALGRIRAGGKVSTWSKETFPL

SEQ ID NO: 3293 - protein, 530 aa, Unknown
  Description of Unknown: uncultivated organism sequence
  Category: MG91 effectors
  Description: MG91-485 effector
MPSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3294 - protein, 537 aa, Unknown
  Description of Unknown: uncultivated organism sequence
  Category: MG91 effectors
  Description: MG91-486 effector
MSTKSFIISLPIITGDQDRRRLQKSFSFGCNLQNAVMGGGWDRVLKMRATAEWQTARAMPKSSERTKAFRDLRVHFRLSEYDFHADVAKHRKASGRGHLLGINEGQKLASRAWISVERHLYNGGSPRFISSRRGLHSIEGKTNRTGIIWKADQQCVTVCKHVYRVRVDKRDDWLTRALQDPTDPTRPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYESLRAELAEIFRLSAATRKREHGEVCNWLLGHAGHIIVEDNSYKAFQKGHFGKSIGRHAPAAFYTQLTSKAESAGLQVTVVSPRKLKPSQHNLLTDTFVKHELWERRVRLGNDDDDRWIDRDAAACLNLLYADLEKQTYVPERIREAVLAGVTAWLDAGVVVIQAREGITEREFGRFRRRGIPSLTVQGLRQQGFRGRSDSKSGATPRRKASTVSKPSHLSGEVV

SEQ ID NO: 3295 - protein, 524 aa, Unknown
  Description of Unknown: uncultivated organism sequence
  Category: MG91 effectors
  Description: MG91-487 effector
MTSQTFILELPIKADDSQSRTIAKKFEYGRMLYNATLGSGLGRLTQMRQDPEWRRACEMSKGKERNELFRRLNRKYRLTEYDFHADIARHREGTKRKSELGINEAQKLATQAFSAVSRYMYKQGGRPRFKSFKRGLHSLEGKTNKTGLKFRPEKMLLDWCRKSYQVMLDSDDAFILDALYADKERTHFKRIKYNRIVCRNIKGVKRFYLQVVLEGTPPVKHAYAPATERMAIDPGPKSFAVFCPRVQAKVQVAPGAKVNEKAIRRIQRSMDRSLRASNPKAFDEKGRIKSGVGLTYSKGYQARVDKLREAHRRAAGTRKCEHGELANLLLECAGNIRIEKNSWEAFKRSHFGRSINNSAASGFIQRLKSKAERAGLTVEEVSPYRLKPSQYDPYKDEFMKKALGERWMYLGDETTVIQRDIMSAILIYFADLKNQTHNPEVVKAALEGLKRGLTDAGYVKQLKLPRSSGSQDPLFAPEPKALTTEELRSKCFRAGSDRHSSTLNGTDGKAVGWSETFPLQRGVV

SEQ ID NO: 3296 - protein, 525 aa, Unknown
  Description of Unknown: uncultivated organism sequence
  Category: MG91 effectors
  Description: MG91-488 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINEAQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGPNNFNEAASRRLLRAMDRSLKRNNPDAYNEDGTIKKGAKLVKSKNYQRKVDRLREMHRVSAAERRCLHGQTINLLLSIAGDIRIEKNSWKAFQRGHFGKSLGKSAMSGFIAQLKSKAESAGLKVTEVNPYKLKLSQYDPYTDTYRKKALSERWQEMKAGSGQYIQRDVLSALLLYCADIEKEIHIPKAAVEQLEGAKQLLTDAGYVVLKSTSSRDQRDPRLAPEPKAMTPEMARQKILRGAGDSHLPTDQALGRIRAGEKVSTWSKETFPL

SEQ ID NO: 3297 - protein, 529 aa, Unknown
  Description of Unknown: uncultivated organism sequence
  Category: MG91 effectors
  Description: MG91-489 effector
MSQSYILSFELTLPQRIYPYLDKLFNVFKWEVRRTVGEIWNEDFFKRFKGRGSASAILKEILKKPPNIPSRVHRNILELSGEIVRSHIERKRIYDYLMEKPCRVLFDEDRIADELNASPLFVLNVQRQVRKILRKEKDKKSYFQVVKPSFNGEVVIFSADDSVENGQFKKLRFSRRYIEFEIKVPDGNSWKWIKVRKLISDRLKKFLTEAKRTCAPLIKKVYLKSGLSIYRLVIPLEFETRFSEGSLKVFSLDLSPSEKRLGVGVIVSPEGHSRPIFFNAEKMVKKLERILKEISNLEKKIDNIADEIHITGNREHKVRLEKRLKHLFAEQKLKWRKFKELRKQILEVFTKLILEYARAYDYSFIAVERLKFSSLPDWKNRRMRRLFSQWFYARFIERLRQKALRYGLRVLLINPYRTSRVCHKCGGEGKLEKLEFKCQCGTYDRDYNASVNIGKRALEKLVSGAKSEPYRGEDIPARFPFPQGTIHLKGKALLSILPLTLLLSYLRLVETSYLKLSRLSRYLQTDKYG

SEQ ID NO: 3298 - protein, 530 aa, Unknown
  Description of Unknown: uncultivated organism sequence
  Category: MG91 effectors
  Description: MG91-490 effector
MPSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAASRRLLRAMDRSLRRNNLDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3299 - protein, 530 aa, Unknown
  Description of Unknown: uncultivated organism sequence
  Category: MG91 effectors
  Description: MG91-491 effector
MPSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTELKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3300 - protein, 530 aa, Unknown
  Description of Unknown: uncultivated organism sequence
  Category: MG91 effectors
  Description: MG91-492 effector
MPSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTKRAAIDPGPQSIALFSKEFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKITEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3301 - protein, 530 aa, Unknown
  Description of Unknown: uncultivated organism sequence
  Category: MG91 effectors
  Description: MG91-493 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGPNNFNEAASRRLLRAMDRSLKRNNPDAYNEDGTIKKGAKLVKSKNYQRKVDRLREMHRVSAAERRCLHGQTINLLLSIAGDIRIEKNSWKAFQRGHFGKSLGKSAMSGFIAQLKSKAESAGLKVTEVNPYKLKLSQYDPYTDTYRKKALSERWQEMKAGSGQYIQRDILSALLLYCADIEEEIHIPKVAVEQLEGAKQFLTDAGYVVLKSTSSRDQRDPRLAPEPKAMTPEMARQKILRGAGDSHLPTDQALGRIRAGGKVSTWSKETFPLQRGVV

SEQ ID NO: 3302 - protein, 532 aa, Unknown
  Description of Unknown: uncultivated organism sequence
  Category: MG91 effectors
  Description: MG91-494 effector
MSTKSFIITLPIITGSEERRWLRKSFSFGCNLQNAVMGGGWDRVQQMRATPEWQAARVMPKGKERTQALRDLRIRFRLSEYDFHADVAQHRKASGRGHLLGINECQKIASRAWISVERHIYKGGSPRFISSKRGLHSVEGKTNKTGIIWKAEKSVFKFAGHTYRVRINKHDDWLTRALQDPTDPAKPRKVKYCRIVRNVRKGKECFDLQLIAEGTSPLKHAYAGKDLRMAIDPGLGSLTYATEDGKIAKVQIAPNADTDHRAVRKIQRAMERSRQATNPENYETVDVVRHGKKRKSLKVKSGRLQWRFSKHYEKLRAELAEIHRLAAATRKREHGEVCNWLLGHAGTIIVEDNSFKAFQRGRFGKSIGRYAPAAFYTQLTSKAESAGLQVKVVSPRKLKPTQHNLLTGRFVKHELWERRVQLGDRTGVCWIDRDAAACVNLLYADLDQQTYDPKRIREAVLAGVTAWLDAGVVVIQARERITEREFRRFRRRGIPSLAVQGLRQKGFRGRSDSKSGATPEEKSLGQIETFPL

SEQ ID NO: 3303 - protein, 530 aa, Unknown
  Description of Unknown: uncultivated organism sequence
  Category: MG91 effectors
  Description: MG91-495 effector
MTSLSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAIKRYKLGLGGMPRFKSSKRGLHSIEGKTNKTGLKFRPEKKVLNWCGHDYRVLINPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLPALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3304 - protein, 526 aa, Unknown
  Description of Unknown: uncultivated organism sequence
  Category: MG91 effectors
  Description: MG91-496 effector
MEEVFVLELPLQVEKYQADILNKRYEQLRQLYNYVQGKLLRQYRYFEQMVEFQACKTIREKRVFFRSHPFNINGKLAGNKELPEITFDEYGINGFVEKMAQKSVGTNMTYADLGFTTNILDHLSASIWSAWEKKLYDYRAKRITFKKYGELDSFSSRRKVVCGKVYFSGVELHLDTMELAIKINGKVGKDAKFITLPILHNPKHTDYEMWALKGGLDSIKVVKVVRRLVRGQYKYYLQLSIEGEKPQKGRTLGKGNVGIDIGPTTIAVSGENIASIDKLASKCDNIQEEITRLARKIDRSRRANNPENFNEDGTIKRGVRLVWNDSKRYKALRKEMAELQRRQAAIRKQQHIDRANVLLKEGDTFIVENNKISGWTRKAKETKVNEKTGKIQKKKRFGKSVANNAPAMFVTILENKVKSLGGEVVKVDTQNAASQYDFTNNSFEKHELKERSVTLSNGDTHQRDMLAAFNLQHLKYDAPEKKQYDTEAMAQHYDHFCELEKAEILRYKNKEKKDDRSTIGAGDLLD

SEQ ID NO: 3305 - protein, 537 aa, Unknown
  Description of Unknown: uncultivated organism sequence
  Category: MG91 effectors
  Description: MG91-497 effector
MSTKSFIISLPIITGDQDRRRLRKSFSFGCNLQNAVMGGGWDRVLKMRATAEWQTARAMPKSSERTKAFRDLRVRFRLSEYDFHADVAMHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYEKLRSELAEMLRLSAATRKREHGEVCNWLLGHAGHIIVEDNSYKAFQRGRFGKTIGRHAPAALYAQLTNKAESAGLLVEVVSPKKLKPSQHNLLTDTFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGVTPRRKASTVSKPSHFSGEVV

SEQ ID NO: 3306 - protein, 532 aa, Unknown
  Description of Unknown: uncultivated organism sequence
  Category: MG91 effectors
  Description: MG91-498 effector
MSTKSFIITLPIITGSEERRWLRKSFSFGCNLQNAVMGGGWDRVQQMRATPEWQAARVMPKGKERTQAFRDLRIRFRLSEYDFHADVAQHRKASGRGHLLGINECQKIASRAWISVERHIYKGGSPRFISSKRGLHSVEGKTNKTGIIWKAEKSVFKFAGHTYRVRINKHDDWLTRALQDPTDPAKPRKVKYCRIVRNVRKGKECFDLQLIAEGTSPLKHAYAGKDLRMAIDPSLGSLTYATEDGKIAKVQIAPNADTDHRAVRRIQRAMERSRQATNPENYETVDVVRHGKKRKSLKVKSGRLQWRFSKHYEKLRAELAETHRLAAATRKREHGEVCNWLLGHAGTIIVEDNSFKAFQRGRFGKSIGRYAPAAFYTQLTSKAESAGLQVKVVSPRKLKPTQHNLLTGRVVKHELWERRVQLGDRTSVCWIDRDAAACVNLLYADLDQQTYDPKRIREAVLAGVTAWLDAGVVVIQAREGITEREFRRFRRRGIPSLAVQGLRQKGFRGRSDSKSGATPEEKSLGQIETFPL

SEQ ID NO: 3307 - protein, 537 aa, Unknown
  Description of Unknown: uncultivated organism sequence
  Category: MG91 effectors
  Description: MG91-499 effector
MSTKSFIISLPIITGDQDRRRLCKSFSFGCNLQNAVMGDGWDRVLKMRATPKWQAARAMPNGSERTKAFRDLRVRFRLSEYDFHADVAKHRKASGRIHLLDINECQELASRAWISVERHLYNGGSPRFISSRRGLHSIEWKTNRTGIIWKADQQCVTVSKHVYRIRVDKHDDWLTRALQDPTDPTKPRRVKYCRIVREMRKGKERFLLQLVAEGTSPLKHAYAGKDLRMAIDPGLGSLTYATEDGTIAKVQIAPSADTDQRAVRKLQRAMERSRQATNPDNYETVGVVRHGKKRKSLKVKAGRLQWRFSKRYEKLRSELAEMLRLSVATRKREHGEVCNWLLGHVGHIIVEDNSYKAFQRGRFGKTIGRHAPAALYAQLASKAECAGLLVEVVSPKKVKPTQYNLLTGQFVKHELWERRVRLGEDDDDRWIDRDAAACLNLLYADLEKQIYAPERIREAVPAGVTAWLDAGVVVIQAREGITEREFGRFRRRGIPSSTVQGLCQQGFRGRSDSKSGATPRRKASTVSKPSHFSGEVV

SEQ ID NO: 3308 - protein, 524 aa, Unknown
  Description of Unknown: uncultivated organism sequence
  Category: MG91 effectors
  Description: MG91-500 effector
MTSPSFILELPIKVNDSESRMILRKFEFARQLHNATLGSALGQLQQMRQDPQWKKACNLPKGKERSELFRNLDRQYRLTEYDLHTVIAKHRERSGRKDQLGINETQKIATRVYQSIRRYQLGLGGRPRFKSISRGLHSIEGKTNVTGLKFNLQKSVLSWCKHDYRVIIDAKDDYIQRALQKEDGTGYKKIKYCRLVRKTIKNRERFFLQVLLEGTAPVKHIYAPDSERLSIDPGPQAIAVFSEQFAGKIQIAPTAKVNEAVIRRMQRSMDRSLRQNNEEAYESNGTLKKGVKLKQTKSYKMRVAQLSDYHRRVAATRRCEHGQLANLLLSLAGDIRIEKNHWKAFQRGHFGKSLGKSGASSFIERLKSKAESAGLKVSEVKPYTLKLSQYDPYTETYRKKALSERWHQLGSSSEWIQRDVLSALLLQCADIEKEKHIPTKIIETLEGAKQLLRDAGYIVDKPSSNGDHCDRPFASEPKAQTPEEVRLEIFCGVGDSRLPLLLRNGSRQKANEKAHVRSKETFSL

SEQ ID NO: 3309 - protein, 639 aa, Unknown
  Description of Unknown: uncultivated organism sequence
  Category: MG91 effectors
  Description: MG91-501 effector
MLTKELRQEALKKGFHYPKVEKSVEFYRTKNLMIYDFVNENRISMLRVCIAEKKAGIYDTFTKTWADCLLSSFLGKAGISVSELLAFALSAEAKKRLSSGHDNFDYLALYKIDQQISYAKNWEKRHPADERKKEISQIMAGTNKRLSAGFIKFNLDLFGDCKRIMYSKSEKAVYCPECESISRISSPPKKGSLYRCPVCCFTAKVSQAENPLTEVHWSCIVQPAGKRSIIRYFCNDFSLQFGKCKIASEEKFRTILEADGSRIELMQTGNGWEDYKEKRYGLYYPSKRDVPYDMFLYGNVKAILKIPVYEHSMLDVWVKQHKNKKNELYTVYLIENYISQYAKNEIFEKLLKFGLNHIAHEAAFHNYNRTFNFNGNKIEDFLNIKMASLKQLRRIINDPFERDIIAMRYLDKNNLYLKDEELKKFLSLNVSNDMKEKIVRFCKFKKVTFYKVNNYVTENANADWSSYFDYIGWTEELEYKKSDSVYYPKKFFKTHDRVFKELEEKKDAIQRKKDKEISKKIAGLWEQRMQIPQYHYENNDLFVMMPHGTSDLKKEGRSLNHCVADYKEFVAEEKTQIFFISKKAAPQKSFYTLEIKNHEIEQCHGRNNVDMTEEIRSFAYGYLKQLNTLNEKAAVKAVA

SEQ ID NO: 3310 - protein, 532 aa, Unknown
  Description of Unknown: uncultivated organism sequence
  Category: MG91 effectors
  Description: MG91-502 effector
MSTKSFIINLPIITGDQDRRRLRKSFSFGCNLQNAVMGGGWDRVLWMRATPEWQAARVMPKGSERTKAFRDLRVQFRLSEYDFHADVAKHRKASGRSHLLGINESQKLASRAWISVERHLYNSGSPRFISSRRGLHSIEGKTNRTGIIWKADQQCVTVCKRVYRVRVDKRDDWLTRALQDPTDPKKPRKVKYCRIVREMRKGKERFLLQLVAEGTSPLKHAYAGKDQRMAIDPGLGSLTYATEDGKIAKVQIAPNADTDHRAVRRIQRAMERSRQATNPDNYETVDVVRHGKKRQSLKVKSGRLEWRFSKRYEKLRAELAQPHRLAAATRKREHGEVCNWLLGHAGTIIVEDNSFKAFQRGQFGKSIGRHAPAAFYTQLTSKAESAGLQVKVVSPKKLKPTQHNLLTGRFVKHELWERRVQLGDRTDVCWIDRDAAACVNLLYADLDQQIYDPKRIREAVLAGVTAWLDAGVVVIQAREGITEREFRRFRRRGIPSLAVQGLRQKGFRGRSDSKSGAIPEAKSLGYIETFPL

SEQ ID NO: 3311 - protein, 492 aa, Unknown
  Description of Unknown: uncultivated organism sequence
  Category: MG91 effectors
  Description: MG91-503 effector
MRATPKWQAARAMPNGSERTKAFRDLRVRFRLSEYDFHADVAKHRKASGRIHLLDINECQELASRAWISVERHLYNGGSPRFISSRRGLHSIEWKTNRTGIIWKADQQQCVTVSKHVYRIRVDKHDDWLTRALQDPTDPTKPRRVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYEKLRSELAEMLRLSVATRKREHGEVCNWLLGHVGHIIVENNSYKAFQRGRFGKTIGRHAPAALYAQLASKAECAGLLVEVVSPKKVKPTQYNLLTGQFVKHELWERRVRLGEDDDDRWIDRDAAACLNLLYADLEKQIYAPERIREAVPAGVTAWLDAGVVVIQAREGITEREFGRFRRRGIPSSTVQGLRQQGFRGRSDSKSGATPRRKASTVSKPSHFSGEVV

SEQ ID NO: 3312 - protein, 530 aa, Unknown
  Description of Unknown: uncultivated organism sequence
  Category: MG91 effectors
  Description: MG91-504 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSFKRGLHSIEGKTNKTGLKFKPEQTVLNWCGHDYRVLIDPKDDYVQRALKENERSDQYRKIKYCRLVRKRIRSSDRFFLQVVLEGTAPVKHVYAPVTERAAIDPGPQSIALFSKAFAGKIQVAGSNNFNEAASRCLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAASAGLKVTEVNPYKLKLSQYDPYTDTYRKKDLSERWQEMKAGSGQYIQRDVLSALLLYCADIEKEIHIPKAAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3313 - protein, 634 aa, Unknown
  Description of Unknown: uncultivated organism sequence
  Category: MG91 effectors
  Description: MG91-505 effector
MLTKDLKQEALKRGFLHSGVNDSIEAYRTRNLAIYDFVCEGSAVVRVCISKQHAGIYDVLNNIWKDCTLENYLEDPNQFANYMLSERAKKLLKTDSLFFDSKASFAIDVQIRKAKNWKKINQKENREKEIKKIMAGTNKPVPSGFKIFSERLLCSAKRIMYSAKEKSLYCPECGNTFQLPGVPKKGSVHTCPACGYRAKVSCVQYQLNDIHWSCIVQAAGKRSVIRYFCNELLLEYGKCSTIFYEKYRTIIEEDGSMVPLMQTSDGWNDYKAKNYSFFYTVPKREEPNDMYLYGTVDALMKMPVLKNSMLDVWVKQHIGADKKLCSEYLVENYIKIYAKTTIYEKLLKCGLNKIAHEAAFYYDSSFHREEKKVDKFLNLTKENLNRLREFIPDPSGSNVSAMRYLEKYNVYLKDDELKTFLRLEVSDNMKEQIIKFCKCKKVTLYKINKYVTENANADWSSYFDYIGWTEELDYKKSDSVYYPKKFFKTHDRVFKELEEKKDAIQRKKDKEISKKIADLWEQRMQIPQYHYENNDLFVMMPHDTSDLKKEGRSLNHCVAGYKEFVAEEKTQIFFIRKKADPQKSFYTLEIKNHDIEQCHGKNNVNMTEEIRTFAYGFLNQLNTIKEKPAVRAAA

SEQ ID NO: 3314 - protein, 530 aa, Unknown
  Description of Unknown: uncultivated organism sequence
  Category: MG91 effectors
  Description: MG91-506 effector
MTSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRQEKKVLNWCGHDYRVLIDPKDNYVQRALKENERSDQYRKIKYCRLVRKRIRSADRFFLQVVIEGTAPVKHVYAPVTERAAIDPGPQSITLFSKAFAGKIQVAGSNNFNEAASRRLLRAMDRSLRRNNPDAYNEDGTINKGAKLAKSKNYQRKVDQLHEMHRVAAAQRKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQLLTDAGYVVLKSTSSRDQRDPRLAPEPKAMTPEMARQKILRGAGDSHLPTDQALGRIRAGGKVSTWSKETFPLQRGVV

SEQ ID NO: 3315 - protein, 530 aa, Unknown
  Description of Unknown: uncultivated organism sequence
  Category: MG91 effectors
  Description: MG91-507 effector
MPSQSFVIELPIAVDEAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3316 - protein, 497 aa, Unknown
  Description of Unknown: uncultivated organism sequence
  Category: MG91 effectors
  Description: MG91-508 effector
MTSPTFIIELPIRVSDSESRTILRKLEFARQLHNATLGTALGQLQQLRQDSEWEKACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNPDCYESDGTLRKGCVLKKTKGYEKRIQRFQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3317 - protein, 537 aa, Unknown
  Description of Unknown: uncultivated organism sequence
  Category: MG91 effectors
  Description: MG91-509 effector
MSTKSFIINLPIITGDQDRRRLRKSFSFGCNLQNAVMGGGWDRVLRMRATPEWQAARVMPKGSERTKAFRDLRVRFRLSEYDFHADVAKHRKASGRGHLLGINECQKLASRAWISVERHLYNGGSPRFISSRRGLHSIEGKTNRTGIIWKADQQCVTVCKRVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGSIIVEDNSFKAFQKGHFGKSIGRHAPAAFYTQLTSKAESAGLQVTVVSPRKLKPSQHNLLTDTFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGTTPRRKASTESKPSHFSGEVV

SEQ ID NO: 3318 - protein, 537 aa, Unknown
  Description of Unknown: uncultivated organism sequence
  Category: MG91 effectors
  Description: MG91-510 effector
MSTKSFIINLPIITGDQDRRRLRKSFSFGCNLQNAVMGGGWDRVLQMRATAEWQATRAMPKGRERTKAFRDLRVRFRLSEYDFHADVAMHRKASGRGHLLGINECQKLASRAWISVERHLYNGGSPRFISSRRGLHSIEGKTNRTGIIWKADQQCVTVCKRVYRVRVDKRDDWLTRALQDPTDPKKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGNDDDDRWIDRDAAACLNLLYADLEKQIYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3319 - protein, 497 aa, Unknown
  Description of Unknown: uncultivated organism sequence
  Category: MG91 effectors
  Description: MG91-511 effector
MTSPTFIIELPIRVSDSESRTILRKLEFARQLHNATLGTALGQLQQLRQDSEWEKACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDFLQRALRSEGRSGFKKVKYCRLVRKTIKGKNRFYLQVVLEGQAPIKHIYASTNERLSIDPGPQTIAVFSDVWAGKIKVSPTAQVDEKRLRCIQRSMDRSLRKSNSDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3320 - protein, 537 aa, Unknown
  Description of Unknown: uncultivated organism sequence
  Category: MG91 effectors
  Description: MG91-512 effector
MSTKSFIISLPIITGDQDRRRLRKSFSFGCNLQNAVMGGGWDRVLKMRATAEWQTARAMPKSSERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKCDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGSIIVEDNSFKAFQKGHFGKSIGRHAPAAFYTQLTSKAESAGLQVTVVSPRKLKPSQHNLLTDTFVKHELWERRVRLGEDDDERWIDRDAAACLNLLYADIENQTYDPERIREAVLAGVTAWLDAGVVVIQAREGITEREFGRFRRRGIPSLTVQGLRQQGFRGRSDSKSGTTPRRKASTESKPSHFSGEVV

SEQ ID NO: 3321 - protein, 1356 aa, Unknown
  Description of Unknown: uncultivated organism sequence
  Category: MG91 effectors
  Description: MG91-513 effector
MLEKPYYLGLDMGTNSVGWAVTDQQYNLLKAKGKDLWGIREFAEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEIFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGKQVLPKASLEYESFRVLNEINNLRIDGERIPVTLKQDIYTDLFQKGKKVTKKQLCNYLATRGLIESSEQVTGIDIAINNSLSTYGKFKAIFGEDIKLDHIQHMIEDIVFWCTVYGDSKQFLKEQIEDKYKGKLSPEQMKRILGFKFKDWGNLSKEFFELKGADKSTGEAVSIIRALWENNLNLMELINSPEFDFKEQLADYEANSLKTLSDFEPEDLNDYYFSAPVRRMIWQTTLIIKELVHVLGKEPARIFIEMTREKDASRGRTLSRKKKFEDLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVCAKAGNVSDFRRNRELPKSRLVNDFHHAHDAYLNIVVGNVYYVKFTQNPINYIKNSYNKDMNKNNYNLSRMFDWDVKRGDEVAWIAQKQDGATGTISTVKKMLSKNTPLMTRLSYEGKGALANETLYSAEKAKGEGYIPFKSSDTKIQDVTKYGGFTSVTGAYFFLVEHDEKKKRIRTIESVPLYLADKIDKDSSELERYCDKLGLVNYDIRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQLSKILGFETDLSLLRTNKQSGKPTREGGMQISKKIDNTTSMYLINQSPTGLFETKIDLQTI

SEQ ID NO: 3322 - protein, 1352 aa, Unknown
  Description of Unknown: uncultivated organism sequence
  Category: MG91 effectors
  Description: MG91-514 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCSKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKRMLSRNTPLMTRYSFEGKGGLANETLCSAKKAKGEGYIPFKSSDDKMQDVTKYGGFTKVTGAYFFLVEHTEKKKRIRTIESVPVYLAQKIEQNPDELKKYCKEILGLVDADIRLKKIKIGSLIKRNGYFCYITGKTGNRLSVRNAVNLCLKNEWIKYISKLEKVKEKDAVDEIITKEKNEVLYSELIQKFKHGIFSKRPNPVEDKLEKGSEKFSNLSIKEQCALLCQILQLAAVLGSECDMTLLGESAHCGKMLISKKIGDEEIYLLNQSVTGLYEKKINLHTV

SEQ ID NO: 3323 - protein, 1033 aa, Unknown
  Description of Unknown: uncultivated organism sequence
  Category: MG91 effectors
  Description: MG91-515 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESSFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAPKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRIIWQTILVIKELVKVLGCEPERIFVEMTRRPDEHKTRTSSRRNKFEELYKKVKDEATDWMQVIAKAEEDGKIRSKKMYLYLTQKGRCMYTGKHIELDDLFDKNLYDIDHIYPRHFVKDDNIDNNLVLVCKEKNAHKSDHYPIEEEIFLSQKKMWLELRKSGFITEEKYNRLMGRSPFSDEQKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEG

SEQ ID NO: 3324 - protein, 1358 aa, Unknown
  Description of Unknown: uncultivated organism sequence
  Category: MG91 effectors
  Description: MG91-516 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHGEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEENCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITYANECILINQSVTGLYENRIDLLRV

SEQ ID NO: 3325 - protein, 1352 aa, Unknown
  Description of Unknown: uncultivated organism sequence
  Category: MG91 effectors
  Description: MG91-517 effector
MTAFKYYLGLDMGTNSVGWAATDPGYRLLKAKGKDLWGIREFNEASGAVERRTHRISRRRRQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRCTRDDIQKSRLVNDFHHAHDAYLNIVVGNVYYVKFTQNPLNFIKKDYDKYKEDYNLSKMFDWDVKRNGEVAWIAQRKDGAAGTITTVKRMLSRNTPLMTRYSFDGKGGLTNETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTVNRLIVRNAVNLCLKNEWIKYISKLEKVKEKDAVDKIITKEKNEVLYSELIQKFKHGIFSKRPNPVGDKLEKDSEKFNNLSIKDQCAVLCQVLRMAAILGSECDMTLLGDSPNCGKMLISKKIGDEEIYLINQSVTGLYEKKINLHTV

SEQ ID NO: 3326 - protein, 613 aa, Unknown
  Description of Unknown: uncultivated organism sequence
  Category: MG91 effectors
  Description: MG91-518 effector
MMAKETFVLTLPLKVEKWQADILDKRYELLRQIYNMVQQKLLRQYIYFSQQKAYKTCKGDFQQIREFFASHPFHFKDIKGRNGEPSDIKFPYTYESRSSSSGKRTPNGISDFISKLWAHRIGEDKTLADFGINSSILEELGLHVMQAWEKRIYDPKSSRVSFKKYGDINSFGSRCKNGSFAGFTINLGKGHITFNTNGRQRKSAELITLPIDFSREKKGYAASALKDGIDSLRKLIIVRKCIRGKNKYYLQLTISGEKPQKGRTLGRGNVGIDIGPSTIAISSLQCVHFEKLADRCDNIEHDLFLVNRKLDRSRRANNPLNFNTDRTIKRISRQKGEHRVWHDSNRYKRLKLVRKELFRKQAEIRKQQHLQMANVILSQGDTFVVENNPIDAWARRAKETTKTKTGKNRCKKRYGKSVANHAPAMFVSILRNKVQSLGGAFHEVDVRYAATQFDFTNGTKTKHEVSERSITLSNGHTHQRDMLSAFNLQHIKLESIGTEDKEYDIEQMEADYPIFRELETAELRRFKVVRHNERDALYFAGASEKHLRHQPQDESVDNRHNGGVGRKHCNTRIGSENAEITGSGLVRESIERVSQVPDEYHISSHQPIVLDGL

SEQ ID NO: 3327 - protein, 530 aa, Unknown
  Description of Unknown: uncultivated organism sequence
  Category: MG91 effectors
  Description: MG91-519 effector
MTSPSFVIELPIAVDDAEMRTIVRKLEFARQLHNATLGTAMGQLQQMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDRLHEMHRVAAAQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKAAVEQLEGAKQLLTDAGYVVLKSTSSRDQRDPRLASEPKAMTPEMARQKILRGAGDSHLPTDQALGRIRAGEKVSTWSKETFPLQRGVV

SEQ ID NO: 3328 - protein, 484 aa, Unknown
  Description of Unknown: uncultivated organism sequence
  Category: MG91 effectors
  Description: MG91-520 effector
MAHKENQKAFVITFPLRTEKWQEDRIDKMMRMLTTLYNDRQRKLVRRYIYLSHSKAYHEAKGKGVVAFKNYMKENGFSQYGLDAFFKADTKGALYQCGLNSMFLQYLSQCAWSAWDKKLFGKGDFVKTDKVVNIFCSRNKNGRFCGFDYDLSTFTIRIKSTCTKEIICSIPFVVNKNSEYELYALSQKICRIGIVRKLIRSKYKYYVQFTFDGVPYNKGRNIGTGIVGIDPGPSKIAIVGDNKVEIVKLAPNIEEDERKTARLKRKLDRSRRATNPHMYNEDGTIIKGQRQTCFSKAYNETRKQLADAQRKLAAKRKIAHNELANTLLEYGDTFKVEANSYKSMQARTKATSMTKSGRIRSKKRYGKSIKNRAPSEFLVILKNKLLYYPKGKYYDVPSSYACTQFDFTNESFTEHKISERRIVTSDGIQHNRDTLAAFNIKNAIVNDTSTKKKKFTKSKEFFDIVKMKASYNKFCVMERYLLSV

SEQ ID NO: 3329 - protein, 1358 aa, Unknown
  Description of Unknown: uncultivated organism sequence
  Category: MG91 effectors
  Description: MG91-521 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDDSQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSGEKSRRNYKERKQEDLYNSIKKLLKSVDNVYDTDIEYIKNEMDKENFLPKQLTFKNGVIPNQIHASELKAILKNAEKYLPFLNEKDESGYTVSERILMLFSFQIPYYVGPVSSNSNGWVKRLESGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQVKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGITGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITDANECILINQSVTGLYENRIDLLRV

SEQ ID NO: 3330 - protein, 537 aa, Unknown
  Description of Unknown: uncultivated organism sequence
  Category: MG91 effectors
  Description: MG91-522 effector
MSTKSFIISLPIITGDQDRRRLRKSFSFGCNLQNAVMGGGWDRVLQMRATPEWQATRAMPKGRERTKAFRDLRVRFRLSEYDFHADVAMHRKASGRGHLLGINECQKLASRAWISVERHLYNGGAPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYEKLRSELAEMLRLCAATRKREHGEVCNWLLGHAGHIIVEDNSFKAFQKGHFGKSIGRHAPAAFYTQLTSKAESAGLQVTVVSPRKLKPSQHNLLTDTFVKHELWERRVRLGKDDDDRWIDRDAAACLNLLYADIENQTYDPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3331 - protein, 537 aa, Unknown
  Description of Unknown: uncultivated organism sequence
  Category: MG91 effectors
  Description: MG91-523 effector
MSTKSFIISLPIITGDQDRRRLRKSFSFGCNLQNAVMGGGWDRVLKMRATAEWQTARAMPKNSERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGSIIVEDNSFKAFQKGHFGKSIGRHAPAAFYTQLTSKAESAGLQVTVVSPRKLKPSQHNLLTGQFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGATPRRKASTVSKPSHLSGEVV

SEQ ID NO: 3332 - protein, 530 aa, Unknown
  Description of Unknown: uncultivated organism sequence
  Category: MG91 effectors
  Description: MG91-524 effector
MTSPSFVIELPIAVDDAEMRTIVRKLEFARQLHNATLGTAIGQLQQMRQDTAWKQACAMPKGKERTAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHIYAPVVERAAIDPGPQSIALFSKEFAGKIQVAGPNNFNEAASRRLLRAMDRSLKRNNPDAYNEDGTIKKGAKLVKSKNYQRKVDRLHEMHRVSAAERRCLHGQTINLLLSIAGDIRIEKNSWKAFQRGHFGKSLGKSAMSGFIAQLKSKAESAGLKVTEVNPYKLKLSQYDPYTDTYRKKALSERWQEMKAGSGQYIQRDVLSALLLYCADIEKEIHIPKAAVEQLEGAKQLLTDAGYVVLKSTSSRDQRDPRLAPEPKAMTPEMARQKILRGAGDSHLPTDQALGWIRAGEKVSTWSKETFPLQRGVV

SEQ ID NO: 3333 - protein, 484 aa, Unknown
  Description of Unknown: uncultivated organism sequence
  Category: MG91 effectors
  Description: MG91-525 effector
MAHKENQKAFVVTFPLRTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNKKERFCGFDYDLSTFTIRIKSTCTKKIICTIPFVVNKNSEYELYALSQKICRIGIVRKLIRSKYKYYVQFTFDGVPYNKGRNIGTGIVGIDPGPSKIAIVGDNKVEIAKLAPNLIEDERKTARLKRKLDRSRRATNPHMYKEDGTIIKGQRQTCFSKVYNETRKQLADAQRKLAAKRKIAHNELANTLLEYGDTFKVEANSYKSMQARAKATSMTKSGRIRSKKRYGKSINNRAPSEFLVILKNKLLYYPKGKYYDVPSSYACTQFDFTNESFTEHKISERRIVTSDGIQHNRDTLAAFNIKNAIVNDTSTKKKKVTKSKEFFDIVKMKASYNDFCLMERYLLSV

SEQ ID NO: 3334 - protein, 525 aa, Unknown
  Description of Unknown: uncultivated organism sequence
  Category: MG91 effectors
  Description: MG91-526 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHIYAPVTERAAIDPGPQSIALFSKAFAGKIQVAGSSNFNESASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETFPL

SEQ ID NO: 3335 - protein, 537 aa, Unknown
  Description of Unknown: uncultivated organism sequence
  Category: MG91 effectors
  Description: MG91-527 effector
MSTKSFIISLPIITGDQDRRRLRKSFSFGCNLQNAVMGGGWDHVLQMRVTPEWHATRAMPKGRERTKAFRDLRVRFRLSEYDFHADVAKHRKASGRCHLLGINESQKLASRAWISVERHLYNGGSPRFISSRRGLHSIEGKTNRTGIIWKADQQCVTVCKHVYRVRVDKCDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGHIIVEDNSYKAFQKGHFGKSIGRHAPAAFYTQLTSKAESAGLQVTVVSPRKLKPSQHNLLTDTFVKHELWERRVRLGNDDDDRWIDRDAAACLNLLYADLEKQTYAPERIREAVLAGVTAWLDAGVVVIQAREGITEREFGRFRRRGIPSSTVQGLRQRGFRGRSDSKSGTTPRRKASTVSKPSHFSGEVV

SEQ ID NO: 3336 - protein, 1108 aa, Unknown
  Description of Unknown: uncultivated organism sequence
  Category: MG91 effectors
  Description: MG91-528 effector
MTAFKYYLGLDMGTNSVGWAATDPEYRLLKAKGKDLWGIREFNEASGAVERRTHRISRRRKQREQVRIGILKDYFHDAICEVDPSFFQRLENSKYHEEDKDVEVRYKNNIFNDSNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYVGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRRPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMGRSPFSDEKKAGFIARQLVETSQGTKGVANILRQLLPGSKIVYAKASNVSEFRHTRDDIPKSRLVNDFHHAHDAYLNIVVGNVYYVKFTQNPLNFIKKDYDKYKEDYNLSKMFDWDVKRNGEVAWIAQRKDGEAGTITTVKKMLSRNTPLMTRYSFEGIFKAYLRNLMRQLEAMEQVECHS

SEQ ID NO: 3337 - protein, 537 aa, Unknown
  Description of Unknown: uncultivated organism sequence
  Category: MG91 effectors
  Description: MG91-529 effector
MSTKSFIINLPIITGDQDRRRLRKSFSFGCNLQNAVMGGGWDRVLRMRATPEWQAARVMPKGSERTKAFRDLRVQFRLSEYDFHADVAKHRKASGRSHLLGINESQKLASRAWISVERHLYNSGSPRFISSRRGLHSIEGKTNRTGIIWKADQQCVTVCKHVYRVRVDKRDDWLTRALQDPTDPTKPRKVKYCRIVRNVRKGKECFDLQLIAEGTSPLKHAYAGKDQRMAIDPGLGSLTYATEDGKIAKVQIAPNADTDHRAVRRIQRAMERSRQATNPDNYETVDVVRHGKKRQSLKVKSGRLEWRFSKRYEKLRAELAETHRLAAATRKREHGEVCNWLLGHAGTIIVEDNSFKAFQKGRFGKSIGRYAPAAFYTQLTSKAESAGLQVKVVSPKKLKPTQHNLLTGRFVKHELWERRVQLGDRTGVCWIDRDAAACVNLLYADLDQQTYDPKRIREAVLAGVTAWLDAGVVVIQAREGITEREFGRFRGRGIPSLAVQGLRQQGFRGRSDSKSGTTPRRKASTVPKPSHFSGEVV

SEQ ID NO: 3338 - protein, 537 aa, Unknown
  Description of Unknown: uncultivated organism sequence
  Category: MG91 effectors
  Description: MG91-530 effector
MSTKSFIISLPIITGDQDRRRLRKSFSFGCNLQNAVMGGGWDRVLKMRATAEWQTARAMPKSSERTKAFRDLRVHFRLSEYDFHADVAMHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYEAVDVVRHGKKKKSFKVKSGRLQWRFSKRYEKLRSELAEMLRLCAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGNDDDDRWIDRDAAACLNLLYADLEKQTYVPERIREAVLAGVTAWLDAGVVVIQAREGITEREFGRFRRRGIPSLTVQGLRQQGFRGRSDSKSGTTPRRKASTESKPSHFSGEVV

SEQ ID NO: 3339 - protein, 535 aa, Unknown
  Description of Unknown: uncultivated organism sequence
  Category: MG91 effectors
  Description: MG91-531 effector
MKTNSLVLSYELTLPQRIYPELDRLFSAFKWEVRGLVDELWNEEGFGLLRKAGSACSILKNAIKKPPVLPSRAYRNILELSGQIIRSHLKRKEIFDYIMDNPHLVFCNENIIARDFDTSPFFVSNIQNQIRNLFQKGKIVQKEDYFSIVKSCFSGNVVITSADDNLEKGQFRRLEIKGDKLIFEIKVPDSKGWKWIKVTKLIPNRLRKVLSRAKTVESPLIKRVFLKSGFTVYKLIIPVQIETKTKDKIEKVFAVDLSPSEKRLGTGVVVSEEGYSKPVFFSAYKMVKKLERLYRELSDLERKIDNIGNQIHRTKKNHRGILYQRLKHLFAERKLRWKKFKELRKQVLEVFINLIIEHAKTYSCDAIAIENLKFKALPDWNSKKFRRHFSLWFYSKFEKRLKHKALRSGLRVIKVNPYRSSRRCHICGYEGKTNRLEFICSKCQKRFDRDYNAAINIGIKALAVYRTKSEPYMGKDIPGSSPFPQVPVHQILPFKFKSLLFTVSFLKLLSYLRVVETSYLKFGKLTGWISLDKCS

SEQ ID NO: 3340 - protein, 524 aa, Unknown
  Description of Unknown: uncultivated organism sequence
  Category: MG91 effectors
  Description: MG91-532 effector
MEEVFVLELPLQVEKYQADILNKRYEQLRQLYNYVQGKLLRQYKYFEQMSEFQACKTIREKRDFFRSHPFHINGHLAGDKELPEITFDEYGIKGFVEKLAQKSVGPNMTYADLGFTTYILDHLGASIWSAWDKKLYDYRAKRISFKKYGEQDSFSSRRKVVRGKVYFSGLELHLDTMELAIKLNGKVGKEAKFVTLRILHNPKHADYEMWALKGGLDSVKVVKVVRRFVRGQYKYYVQLSIESEKPQKGRTLGKGNVGIDIGPTTVAVSGENIACIDKLASNCDNIQEEITRLARKIDRSRRANNPQNFNEDGTIKRGVRLVWNDSKRYKALRREMAELQRRQAAIRKQQHIDRANELLKEGDTFIVENNQISGWTRKAKETKVNEKTGKIQKKKRFGKSVANHAPAMFVTILENKVKSLGGEVVKVDTQNAASQYDFTNGEFTKHELGERTVTLSNGDTHQRDMLAAFNLQHLKYDAPEKKQYDTKAMAQHYERFCELEQEEIMRYKNKEKKDDHSTIGAEKL

SEQ ID NO: 3341 - protein, 467 aa, Unknown
  Description of Unknown: uncultivated organism sequence
  Category: MG91 effectors
  Description: MG91-533 effector
MGSCSENARHGRVADRKSHADVASGRGHLLGINECQKLASRAWISVERHLYNGGAPRFISSRRGLHSIEGKTNRTGIIWKADQQCVTVCKHVYRVRVDKRDDWLTRALQDPTDPTKPRKVKYCRIVREMRKGKERFFLQLVAEGSSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYEKLRSELAEMLRLCAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGNEDDDRWIDRDAAACLNLLYADLEKQTYAPERIREAVPAGVTARLDAGVVVIQAREGITDREFGRFRRRGIPSLTVQGLRQQGFRGRSDSKSGATPRRKASTVSKPSHFSGEVV

SEQ ID NO: 3342 - protein, 524 aa, Unknown
  Description of Unknown: uncultivated organism sequence
  Category: MG91 effectors
  Description: MG91-534 effector
MNEVFVLELPLQVEKYQADVLNKRYEQLRQLYNYVQGKLLRQYRYFEQMKEFQACKTIKEKRDFFRSHPFQINETLKGNKIPFMVSFDEYSIKGFVEKLAQKPVGANMTFADLGFTTYILDHLGASIWAAWDKMLYDFKAKRISFKKYGELDSFSSRRKLVGGKVYFSGMEVHLDTMELAIKMNGKVGKEAKFITLKILHNPKHADYELWALKGGVNSVKVVKVVRRLVRSQYKYYVQLTIEGEKPQKSRRLGKGNVGIDLGPTTVAVSGVNVVSIDKLASKCDDIQEEITRLSRRIDRSRRANNPQNFNENGTIKRGIKLVWNDSNRYKELRRELAELRRKQAAIRKQQHIERANALLKEGDTFIVENNPISSWTTRAKETKVNEKTGKIQKKKRFGKSVANHAPSMFVSILENKVKSLGGDLVKVDTKNAASQYDFTNNSFTKHELKERNVTLSNGDTHQRDMLAAFNLQHLQYDEKDDKQYDTEAMTADYERFCQLEQEEILRYKNKEKKDDRGTIGAEKL

SEQ ID NO: 3343 - protein, 1358 aa, Unknown
  Description of Unknown: uncultivated organism sequence
  Category: MG91 effectors
  Description: MG91-535 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVTGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKDSLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWVAPEEGETGTLATVKKMLSRNTPILTRLTIEGHGGIADATLYSHKKAKQDTYIPLKSSDARMADVTKYGGYSSVTTAYLFLVEHEIKGKKIRTLETVPIYLKDRLENSKEKLEEYCRETLGYTNPSVRMKKIKLQSLIKLNGYYMQISGRTGNRFTLRNYVQLCLNGKWVDYIHKLEKYQDKGVIDDLITDERNVELYNVLCEKHSVGIFTLRPNLVGDKIKNGYDKFVNLTTEEQIKLLIEIIKLTCVGIVSANLTLIGGAAISGKMLMSKNITDANECILINQSVTGLYENRIDLLRV

SEQ ID NO: 3344 - protein, 1352 aa, Unknown
  Description of Unknown: uncultivated organism sequence
  Category: MG91 effectors
  Description: MG91-536 effector
MTAFKYYLGLDMGTNSVGWAATDPEYRLLKAKGKDLWGIREFNEASGAVERRTHRISRRRRQREQVRIGILKDYFHDAICEVDPSFFRRLENSKYHEEDKDVEVRYKNNIFNDGNYTDKDYFNEYPTIYHLRNELISSTEKHDVRLVFLALLNMFKHRGHFLNAGLGENNGESNIDNAYFELTELLSELTEYHLSQDIDCKQIEAILSRRDMSRTHKAEELAGVLHVDLKNKPYKELIRGLCGLKFNACVVFPDVQSEEVTKLDICLSESTFDEKSDEIANIIGEDYFEIIMAMKEMFDIGSLASIMKGHNYLSQARVASYTKHKEDLKLLKEVIKKYCGKKEYDKFFNSDADGSYASYVGSYNSKNKERRVGNKRTSEELYKEIKKLLKDAQKEDENVQKILTSIENETFLPKQLTASNGVIPNQVHAREMKKILSNAENYLPFLTEKDETGLSVSERILKLFTFQIPYYIGPTSENSGKNGGNGWVVRREDGQVLPWNIDEKIDMKATSEAFISRMVRRCTYISGEQVLPKASLEYQSYCVLNEINNIKIDGERISVELKQDIYKAVFQKGKKVTKKQLCKYLHTRGIIETEEQVTGVDVSINNALTTYGKFKPIFGEDISKDSVQKMIEDIVFWCTVYGDSKKFLKDRIEEKYGNKLSEEQIKRILGFKFKDWGNLSKKFLELNGADTSTGESISIIRALWNNNLNLMELINSSLYNYKECLAEYQNTMLKTLSEIEAEDLNEYYFSAPVRRMIWQTILVIKELVKVLGCEPERIFVEMTRKPDEHKTRTSSRRNKFEELYKKVKDETTDWMQVIANAEEDGKIRSKKMYLYLTQKGRCMYTGKHIELDDLFDNNLYDIDHIYPRHFVKDDNIDNNLVLVCKEKNAHKSDHYPIEEEIFLSQKKMWLELRKSGFITEEKYNRLMDRNPFSDEQKAGFIARQLVETSQGTKGVANILRQLLPGSKIVYAKASNVSEFRHTRDGIPKSRLVNDFHHAHDAYLNIVVGNVYYMKFTQNPLNFIKKDYDNYKEDYNLSKMFDWDVKRNGEVAWIAQRKDGEAGTITTVKKMLSRNTPLMTRYSFEGKGGLANETLYSAKKAKGEGYIPFKSSDDKMQDVTKYGGFTSVTGAYFFLVEHTEKKKRIRTIESVPVYLAQKIEQNPDELKKYCEEILGLIDADIRLKKIKIGSLIKRNGYFCYITGKTGKQLIVRNAVNLCLKNEWIKYISKLEKVKEKDAVDKIITKEKNEVLYSELIQKFKHGIFSKRPNPVGDKLEKGSEKFSNLSIKEQCAVLCQILQLAAVLGSECDMTLLGESAHCGKMLISKKIGDEEIYLINQSITGLYEKKINLHTV

SEQ ID NO: 3345 - protein, 510 aa, Unknown
  Description of Unknown: uncultivated organism sequence
  Category: MG91 effectors
  Description: MG91-537 effector
MREQVLSYELTLPQRIYSHLDRLFSVFKNQVNSYIPRLWNEKGFELLSQKGSAMGILKEVFSTPQGLPSRVFRNVLELTGQIVRSQIKRKEIFESLLKGEEVTGYDENFLLNVKRQLEKLKKKGKEVNSYFDFPYPKFNGQVVITSADDNLEKGQFKRLRISGSFLEFSIKVPTQDGWKWIKVRKLLPNRLRKALLKAKKIEAPLIKKQRLKSGYTVYRLVIPLSFEVTEPKEIDRVLALDLSSQEKRLGVAVIMDKEFVSKPIFFKTELIRKVERIYKETCNLERKIDDVYNAIRNTGSRKVKQELAKRLNHLFGEQKRKQRKCKELRKQILENFTNFVIAHAKAYHCQVIAIENLAFKEVPNWQSSKALRLFTQWFYSRFTKRLEEKARVSGLKVLKINPANTSRICAKCGKEGRLEKLTFECSCGTYDRDYNASLNVAQRALRLTKSRAYTVRDIPGRIPSRLVRAEGLALLTVISLFKLLAWLKVVQTCYLKPQNLIRWINSDKYD

SEQ ID NO: 3346 - protein, 528 aa, Unknown
  Description of Unknown: uncultivated organism sequence
  Category: MG91 effectors
  Description: MG91-538 effector
MNEVFVLELPLQVEKYQADVLNKRYEQLRQLYNYVQGKLLRQYRYFEQMKEFQACKTIKEKRDFFRSHPFQINETLKGNKIPFMVSFDEYSIKGFVEKLAQKPVGANMTFADLGFTTYILDHLGASIWAAWDKMLYDFKAKRISFKKYGELDSFSSRRKLVGGKVYFSGMEVHLDTMELAIKMNGKVGKEAKFITLKILHNPNHADYELWALKGGVNSVKVVKVVRRLVRSQYKYYVQLTIEGEKPQKSRRLGKGNVGIDLGPTTVAVSGVNVVSIDKLASKCDNIQEEITQLSRKIDRSRRANNPQNFNEDGTIKRGIKLVWNDSNRYKELRRKLAELRRKQAAIRKQQHIERANALLKEGDTFIVENNPVDAWVRRAKETKVDEKTGKYKSKRGSGRSVGNHAPAMFVDILENKVKSLGGRFERVNTQNAASQYDFTTDSFKTGEEKHKLNERAITLSNGDTHQRDMLAAFNLQHLKLDEAKTKQYDTEAMAADYERFCQLEQEEILRYKNKVKKDDRGTIGAEKL

SEQ ID NO: 3347 - protein, 497 aa, Unknown
  Description of Unknown: uncultivated organism sequence
  Category: MG91 effectors
  Description: MG91-539 effector
MPSPTFIIELPIRVSDSESRTILRKLEFARQLHNATLGTALGKLQQLRQDSEWKRACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLKKSNPDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3348 - protein, 1353 aa, Unknown
  Description of Unknown: uncultivated organism sequence
  Category: MG91 effectors
  Description: MG91-540 effector
MEQKTYYLGLDMGTNSVGWAVTDENYNLLRAKGKDLWGIREFESASGAIERRAHRVSRRNRQRQQVRVGKLNCYFEDAINEVDPNFYARLRNSKYHLEDKEEAVRTPNGIFNDPAYKDKDYYAQYPTIYHLRKELLTNDEPHDVRLVYLALLNMFKHRGHFLNAALTSEGTRHMQDAYNSFQENVYEMCDLSFPDVDGKEIEAVLSNRDLNRSRKSEALMELFHFTKKENKTELEFVKGMCGLTTEASKLFGDLGLEEKVEICFSKASYEDRIPDIMDAVGEENFRVLENLKEIADIGTLAGVLKGYTYLSEARVAEYEKHKSDLKLLKSVIRQYGTQEDYNKMFRSEESGTYSAYVNSYNSGKKQRRDMKGRTREDFYKSLKKLLKGMPEEDENVAQILAEIDKEKFLPKQLTASNGVIPNQVHLKEMKAILRNAEQYLPFLKEVDESGLTTSERIWRLFSFQIPYYVGPVTPNSSRDGGNGWVVRKEEGEVLPWNINEKIDLPATQDAFIKRLVRECTYISGEKVLPKGALIYEKFAVLNEINNIRIDNERLDTPLKQAIYNDLFCTGKRITRKKILDYLSAQGKLKNESQLTGIDKNINNSLSSYGKFLGVFGEDLKKDHYIDMSEDIIYWCTVYGDSKKVLRSLLEEKYQGELTEKQMKRILGFKFGDWGRMSREFLELEGIDKETGEVVTLIHAMWDNSMNMMELIHSDRFTFAESLESKKTKMDKTLSEFKHEDLDEYYFSAPVKRMIWQTLLVIKELEKVLGGPPTRLFVEMTRSDDVKGDKGRKKSRKDELLELYKKVKDESHDWTAIINAADENGTIRSKKMYLYLTQRGRCMYTGKPIDLNQLFDNNIYDIDHIYPRHFVKDDNLRNNLVLVDKRANARKSDNYPIESNIRCNDSIKALWYSLKKEKLISEEKYRRLTGSNPFSDEQKAGFIARQMVETSQATKGVNDLLKQLLPETELVYSKASNVSDFRRDYDLLKSRTINDFHHANDAYLNIVVGNVFLVKFTNNPRNFIKEYNRDKYTYGYNLGRIFERDVKRGDQVAWIADDRNGNHGTIETVKKMMAKHTPLLTRMNFVNNGQISKGTLYSKFKAKPDTYIPLKETDEKMRDISKYGGFTNVSTAYFFLVEHGKANKRIRTIEAVPIYMKSRLENNEEELKKYCVEQLGLLDPSIRLNKIKIQSQFRINGFYVFFRGKTGHELLWGNNTSLCLEPKWNNYISYLDKYAKNGYMNRFITKEENEHLYSELLKKHSEAIFSKRPNSFSKIVIAGQEKFKDLDIEKQCVALSQLISATSIGSSIADVTMIGGTAQTGRMRTNKKISGYELVLINTSATGLYKTEIDLNKI

SEQ ID NO: 3349 - protein, 530 aa, Unknown
  Description of Unknown: uncultivated organism sequence
  Category: MG91 effectors
  Description: MG91-541 effector
MTSPSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDNYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAASAGLKVTEVNPYKLKLSQYDPYTDTYRKKDLSERWQEMKAGSGQYIQRDVLSALLLYCANIEKEIHIPKVAVEQLEGAKQFLTDAGYVVLKSTSSRDQRDPRLASEPKAMTPEMARQKILRGAGDSHLPTDQELGRIRAGGKVSTWSKETFPLQRGVV

SEQ ID NO: 3350 - protein, 530 aa, Unknown
  Description of Unknown: uncultivated organism sequence
  Category: MG91 effectors
  Description: MG91-542 effector
MTYQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTKRAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKITEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3351 - protein, 607 aa, Unknown
  Description of Unknown: uncultivated organism sequence
  Category: MG91 effectors
  Description: MG91-543 effector
MAKEEFVLTLPLKVEKWQADILDKRYEMLRQVYNMVQQKLVRQYIYFSQQKAYRDCKNFEQRREFFANNPFHIKGVKGKNDELCDIKFPYTFKSRGGTSGKRVPNGISDYVSKLWSHKIGQDKTLADFGINSYIMEELGLHIMKAWEDRLYKPRSKRVSFKDYGEINSLGSRNKNGNIAGFTINLDEGYITYKTNGRLGQFADFIQLPIDFSREKNGYAKEALKGGIDSLKKLLIVKRCVRGENKYYLQLTISGEKPQKGRTLGKGNVGIDIGPSTIATSSLKGVHFDKLADKCDNIEHELYLINRKLDRSRRANNPQNYNEDGKIKRGIRLVWKKDKDVKRYATLKQQRKELYRKQAEIRKQQHLEMANAMLSQGDTFIVENNPVDAWVRRAKETTKTKTGKNRCKKRYGKSVANHAPSMFVSILKNKVLSLGGKFYEIDPRNAATQFDFTNGEFTKHEVCERSITLSNGCTHQRDMLSAFNLQHIVLQSKELKEYDIEQMKADYPIFCRLESSEQERFRIAWHNERDALYFVGASEKQMRRQPQEKSVANRHNGVVGRKYCNTSLEGENAKITGSGLVRESIERVSQIPDECHPFGGAPIVLDGL

SEQ ID NO: 3352 - protein, 601 aa, Unknown
  Description of Unknown: uncultivated organism sequence
  Category: MG91 effectors
  Description: MG91-544 effector
MIEEFVLTLPLKVEKWQADILNNRYEHLRRIYNMVQRKLLRQYIYYSQQSEYRKCKSNDEKRDFWENHPFTIKGIYDQKGNSSIVKFPYTYSSRSKNSGKRASNGISDLLPKLKHYNIGGGKTYGSLGLNASILENLGLSVQQAWEKRIYNSKSKHISFKKEDELNTFGCREKDGFSGFVLDLSKMELSFNTNGLHGKKAEFIHLPINPNKKFTQYEVEALKGGPESVRKIVISREYIRGAYKYYVQLTIRGEKPQKNRTLGKGTVGIDVGPSTVAVSSLYGVALNKLADKCDGIEHDLWLVNRKMDRSRRATNPDFFAEDGTYIKRKKGERRIWNFSNRYKNLKSVRRELYRRQAVVRKQQHIAMANEMLSQGDTFIVENNPVDSWTRRAKETKKNKKGKMRCKRRFGKSVAHHAPAMFVSILQNKVRSLGGEFHKVDIKIAATQFDFTNGEYKKHELKERTVTLADGKTHQRDMMAAFNLQHFRADSSEDYDIEQMILDYPVFCKLEEQGIANYIESKGEEKDTAYFAGKSSKELKRSSNRHNGGVERKHCNIHERKGDAAESGKKTLFGGISESLESVPDVPNECHHLGHQHLRLDEP

SEQ ID NO: 3353 - protein, 448 aa, Unknown
  Description of Unknown: uncultivated organism sequence
  Category: MG91 effectors
  Description: MG91-545 effector
MKTAATPSFVAELPLRVGADVEALLERTFDFARNLYNATLGTVLGRYQALRESQAWQLARAVPKKEAGEVFNRLMRQAELTKSGFEKILNKHRHSSGRAEQLDSNSGQKIADRLWDAFMRYRTRQGGKPRFKSERRGIHSIEGKTNTTGFRWKAQEGCVRWGKRRLPVIVNKQDDWLMRALADPVDPSKPRRVKCYRILWRKFGGRKRWFVQLVCEGVSPVKHIFAPTELKAGIDPSTKSMTVAYACGTVEKIDLATPLKKADREIRLLQRKLDRSRRATNKDNYNEDKTVKKGASGWVYSKHYEKIRTVYADAQRRAAAHRKCVCNEAVNWVLGQAGCIIVEKNNFKAFQKSRYGKSISKAAPGQFVTNLNVKAVSAGLKVFIVPPYELRPSQHDIETGQYVRHELCERWVKLGQSGLWLNRDALAALNLLWLDDAATRYSAARRSE

SEQ ID NO: 3354 - protein, 519 aa, Unknown
  Description of Unknown: uncultivated organism sequence
  Category: MG91 effectors
  Description: MG91-546 effector
MTSQTFILELPIKADDSQSRTIAKKFEYGRMLYNATLGSGLGRLTQMRQDPEWRRACEMSKGKERNELFRRLNRKYRLTEYDFHADIARHREGTKRKSELGINEAQKLATQAFSAVSRYMYKQGGRPRFKSFKRGLHSLEGKTNKTGLKFRPEKMLLDWCRKSYQVMLDSDDAFILDALYADKERTHFKRIKYNRIVCRNIKGVKRFYLQVVLEGTPPVKHAYAPATERMAIDPGPKSFAVFCPRVQAKVQVAPGAKVNEKAIRRIQRSMDRSLRASNPKAFDEKGRIKSGVGLTYSKGYQARVDKLREAHRRATGTRKCEHGELANLLLECAGNIRIEKNSWEAFKRSHFGRSINNSAASGFIQRLKSKAERAGLTVEEVSPYRLKPSQYDPYKDEFMKKALGERWMYLGDETTVIQRDIMSAILIYFADLKNQTHNPEVVKAALEGLKRGLTDAGYVKQLKLPRSSGSQDPLFAPEPKALTTEELRSKCFRAGSDRHSSTLNGTDGKAVGWSETFPL

SEQ ID NO: 3355 - protein, 1353 aa, Unknown
  Description of Unknown: uncultivated organism sequence
  Category: MG91 effectors
  Description: MG91-547 effector
MEQKTYYLGLDMGTNSVGWAVTDENYNLLRAKGKDLWGIREFESASGAIERRAHRVSRRNRQRQQVRVGKLNCYFEDAINEVDPNFYARLRNSKYHLEDKEEAVRTPNGIFNDPDYKDKDYYAQYPTIYHLRKELLTNDEPHDVRLVYLALLNMFKHRGHFLNAALTSEGTRHMQDAYNSFQENVYEMCDLSFPDVDGKEIEAVLSNRDLNRSRKSEALMELFHFTKKENKTESEFVKGMCGLTTEASKLFGNLGLEEKVEICFSKASYEDRIPDIMDAVGEENFRVLENLKEIADIGTLAGVLKGYTYLSEARVAEYEKHKSDLKLLKSVIRQYGTQEDYNKMFRSEESGTYSAYVNSYNSGKKQRRDMKGRTREDFYKSLKKLLKGMPEEDENVTYILAEIDKEKFLPKHLTASNGVIPNQVHLKEMKTILRNAEQYLPFLKEVDESGLTTSERIWRLFSFQIPYYVGPVTPNSSRDGGNGWVVRKEEGEILPWNINEKIDLPATQDAFIKRLVRECTYISGEKVLPKGALIYEKFAVLNEINNIRIDNERLDTPLKQAIYNDLFCTGKRITRKKILDYLSAQGKLKNESQLTGIDKNINNSLSSYGKFLGVFGEDLKKDHYIDMSEDIIYWCTVYGDSKKVLRSLLEEKYQGELTEKQMKRILGFKFGDWGRMSREFLELEGIDKETGEVVTLIHAMWENSMNMMELIHSDRFTFAESLESKKTKMDKTLSKFKHEDLDEYYFSAPVKRMIWQTLLVIKELEKVLGGPPTRLFVEMTRSDDVKGDKGRKKSRKDELLDLYKKVKDESHDWSAIINAADENGTIRSKKMYLYLTQRGRCMYTGKPIDLNQLFDNNIYDIDHIYPRHFVKDDNLRNNLVLVDKRANARKSDNYPIDSNIRCNDSIKALWYSLKKEKLISEEKYRRLTGSNPFSDEQKAGFIARQMVETSQATKGVNDLLKQLLPETELVYSKASNVSDFRRDYNLLKSRTINDFHHANDAYLNIVVGNVFLVKFTNNPRNFIKEYNRDKYTYGYNLGKIFERDVKRGNEVAWIADDRNGNHGTIETVKKMMAKNTPLLTRMNFVNNGQITKGTLYSKSKAKQDTYIPLKESDEKMRDISKYGGFTNVSTAYFFLVEHGKANKRIRTIEAVPIYLKSRLENNDEALKNYCVEKLGLMDPSIRLDKIKIQSQFRVNGFYVFFRGKTGHRLIWGNNTSLCLEPKWNNYISYLEKFEKNGNMNRFVTKEENEHLYSELLKKHSQAIFSKRPNSFSKIVIAGQEKFKDFDIEKQCVALSQLISATSIGSSIADMTMIGGTARTGYMLTNQKISGYELVLINTSPTGLNKTEIDLNTI

SEQ ID NO: 3356 - protein, 514 aa, Unknown
  Description of Unknown: uncultivated organism sequence
  Category: MG91 effectors
  Description: MG91-548 effector
MNNETFIMELPLIVEKFQSDELDKRFEILRRIYNMAQNKLERQFCYLSKFKEYQECTTKKAKGEFIKKHPFSFKDILDKSGNPLMITFTKYDIQGYLSKFAKLKIDSQYTYSDMGINTPMLMHMGMAIWSAWEKVIFDSKADKISYKKYGDLKSIGVDWEPKHPAGFILDLQKGELKLNLNNRQGQYARYITMKIRFGRKEHQVWYEGDALNAGEDSIRVLTIVRRKIRGRYNYYLQMTIRNNKPQKGRTLGEGRVAIDLGTSKIAVVTKDKVHLLPLSPSILSISDELRIIQRQMDRSRRANNPQKFNEDGSIKKGNHDKWVNSKEYIRLRNMKAELERKQAAVRKQDHIALANYLLSLGNEFVIEDNDVQEWVKRKKEEKRRKSDGKNLSKAGLGKQVGNHAPSMFVTILKNKVESLGGTFVRVDNNNRATDYDFTNNTFNEHKLEERYITLGNGNRHQRDTLAAFNLYHLDTAPEKEKCYHLYEMRKHYAQFCESEKEALLRWKGMTPKRE

SEQ ID NO: 3357 - protein, 422 aa, Unknown
  Description of Unknown: uncultivated organism sequence
  Category: MG91 effectors
  Description: MG91-549 effector
MERHLYNGGSPRFISSRRGLHSIEGKTNRTGIIWKADQQCVTVCKRVYRVRVDKRDDWLTRALQDPTDPTKPRRVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGTTPRRKASTVSKPSHFSGEVV

SEQ ID NO: 3358 - protein, 524 aa, Unknown
  Description of Unknown: uncultivated organism sequence
  Category: MG91 effectors
  Description: MG91-550 effector
MNEVFVLELPLQVEKYQADILNKRYEQLRQLYNYVQGKLLRQYRYFEQMKEYQACKTIKEKRDFFKSHPFQINETLKGNKTPFTVSFDEYSIKGFIEKLVQKQVGPNMTYADLGFTTYILDHLGASVWAAWDKKLYDFKAKRISFKKYGELDSFSSRRKVVGGKVYFSGMELHLDTMELSIKMNGKQGNNAKFITLKMLHNPKHAEYEIWALKGGVDSVKVVKVVRRLVRTQYKYYVQLTIEGEKPQKGRTLGKGNVGIDLGPTTVAVSGEHIVSIDKLASKCDNIQEEITRLSRKIDRSRRANNPQNFNEDGTIKRGIKLVWNDSKRYKEMRRELAELRRKQAAIRKQQHIERANALLKEGDTFIVENNQISSWTTRAKETKVNEKTGKIQKKKRFGKSVANHAPSMFVSILENKVKSLGGEVVKVDTKNAASQYDFTDNSFTKHELKERNVTLSNGDTHQRDMLAAFNLQHLKYNEPEAKQYDTEAMVADYDRFCQLEQEEIQRYKNKEKKDDRSTVGAEKL

SEQ ID NO: 3359 - protein, 607 aa, Unknown
  Description of Unknown: uncultivated organism sequence
  Category: MG91 effectors
  Description: MG91-551 effector
MIEEFVLTLPLKVETWQADILNKRYEHLRCIYNMVQRKLLRHYIYLSQQNEYRQCKDNDEKRTFWENHPITFKDFCDKNGNPAIVKFPYTYSHRSKDSGKKASNGISDFVPKFKNRNIGGGLTYGSLGINASILENLGLRIEQAWKKRLYDPKSKHISFKEEGDLNTLGCREKDGFSGFVLDLQKMMLSFNTNGRRHGSAEYIHLPIKPSKLTKYEKFVIDALKDKLSSVRKIVVAREYVRGKYKYYVQLTIKGEKPQKNRTLGKGTVGIDVGPSTVAVSSLQGVSLDKLADKCDNIEHDLWHINRKMDRSKRDTNPDFFNEDKTYKKPEKGERRKWTFSNRYKRLKLERRELYRKQAAIRKQQHIEMANALLSQGDEFIVENNPIDSWAKRAKETKRGKNGKIRCKRRFGKSVAHHAPAMFVSILQNKVRSLGGSFHKVEIKNAATQFDFTNGEFTKHELNERTVTLSNGRTHQRDMLSAFNLQHLRPDSEETKNYNIEQMEADYPVFCKLEEKGIAQFKEKRQQERDVAYFTGVSHKTLKFSSANRHNGGVGRGNCNYHAGSKRNVAKTGNKSSSKENCESMETVSLVPNEYHHSNHQHLRLDGL

SEQ ID NO: 3360 - protein, 342 aa, Unknown
  Description of Unknown: uncultivated organism sequence
  Category: MG91 effectors
  Description: MG91-552 effector
MRAAFSFCAIAETLGSEIVVENDNVTVKPNNARSKEILQACVIDGLKIQYDEMRHWIKELYPSLMSSCTSKIGYVIGKMMTMKDQDIKKCQKKFLIVNGKRAFAQFNRSGIPLKSGMAKIDGHLLKCRWDKDIGEVEFTTNKMDSSTYYAFSSLREARDGWNIKDSYLSFDEDKNKIIVILSYERPDTPSKVNADKVMYVEFTDDKEKFITCYTDNKWSARPFSAAGIVGYLEEMERIYSRYWSEFKSYERREIKQRKHVKEKLNRYTERRANAEKNNNHLWSKRIVDFSRQQCAGKLFVVNLPEKTLFDLPYGWFDLKTKLDYKMKEIGGTVSFVSVDKDK

SEQ ID NO: 3361 - protein, 537 aa, Unknown
  Description of Unknown: uncultivated organism sequence
  Category: MG91 effectors
  Description: MG91-553 effector
MSTKSFIISLPIITGDQDRRRLQKSFSFGCNLQNAVMGGGWDRVLKMRATAEWQTARAMPKSSERTKAFRDLRVHFRLSEYDFHADVAKHRKASGRCHLLGINESQKLASRAWISVERHLYNGGSPRFISSRRGLHSIEGKTNRTGIIWKADQQCVTVCKRVYRVRVDKRDDWLTRALQDQTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGNDDDGRWIDRDAAACLNLLYADLEKQTYAPERICEAVLAGVTAWLDAGVVVIQAREGITEREFGRFRRRGIPSLTVQGLRQQGFRGRSDSKSGTTPRRKASTVSKPSHFSGEVV

SEQ ID NO: 3362 - protein, 484 aa, Unknown
  Description of Unknown: uncultivated organism sequence
  Category: MG91 effectors
  Description: MG91-554 effector
MAHKENQKAFVVTFPLHTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNMKGRFCGFDYDLSTFTIRIKSTCTKKIICTIPFVVNKNSEYELYALSQKICRIGIVRKLIRSKYKYYVQFTFDGVPYNKGRNIGTGIVGIDPGPSKIAIVSDEKVEIAKLAPGIEEDERKTARLRRKLDRSRRATNPHMYKEDGTIIKGQRQTYFSKVYNETRKQLADAQRKLAAKRKIAHNELANTLLEYGDTFKVEANSYKSMQARTKATSMTKSGRIRSKKRYGKSINNRAPSEFLVILKNKLLYYPKGKYYDVPSSYACTQFDFTNESFTEHKISERRIVTSDGIQHNRDTLAAFNIKNAIVNDTSTKKKKITKSKEFFDIVKMKASYNEFCVKERYLLSV

SEQ ID NO: 3363 - protein, 634 aa, Unknown
  Description of Unknown: uncultivated organism sequence
  Category: MG91 effectors
  Description: MG91-555 effector
MPVTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRQEKKVLNWCGHDYRVLIDPKDNYVQRALKENERSDQYRKIKYCRLVRKRIRSADRFFLQVVIEGTAPVKHVYAPVTERAAIDPGPQSITLFSKAFAGKIQVAGSNNFNEAVSRRLLRAMDRSLRRNNPDAYNEDGTINKGAKLAKSKNYQRKVDQLHEMHRVAAARRKCLHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVVQKFDDRSEGLDMQTVYLSAGYTMGPHYFAGSIGWLNAELNGSAEGYPQDDGAAFLGALVYYYSLSKRTQLYAFTSFVDGKQLLDAGTDFNQTTGGFGLMHKF

SEQ ID NO: 3364 - protein, 532 aa, Unknown
  Description of Unknown: uncultivated organism sequence
  Category: MG91 effectors
  Description: MG91-556 effector
MSTKSFIINLPIITGDQDRRRLRKSFSFGCNLQNAVMGGGWDRVLWMRATPEWQAARVMPKGSERTKAFRDLRVQFRLSEYDFHADVAKHRKASGRSHLLGINESQKLASRAWISVERHLYNSGSPRFISSRRGLHSIEGKTNRTGIIWKADQQCVTVCKHVYRVRVDKCDDWLTRALQEPTDPTKPRKVKYCRIVREMRKGKERFLLQLVAEGTSPLKHAYAGKDQRMAIDPGLGSLTYATEDGKIAKVQIAPNADTDHRAVRRIQRAMERSRQATNPDNYETVDVVRHGKKRQSLKVKSGRLEWRFSKRYEKLRAELAQTHRLAAATRKREHGEVCNWLLGHAGTIIVEDNSFKAFQRGQFGKSIGRHAPAAFYTQLTSKAESAGLQVKVVSPKKLKPTQHNLLTGRFVKHELWERRVQLGDRTGVCWIDRDAAACVNLLYADLDQQIYDPKRIREAVLAGVTAWLDAGVVVIQAREGITEREFRRFRRRGIPSLAVQGLRQKGFRGRSDSKSGAIPEAKSLGYIETFPL

SEQ ID NO: 3365 - protein, 1358 aa, Unknown
  Description of Unknown: uncultivated organism sequence
  Category: MG91 effectors
  Description: MG91-557 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDVIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSGENGTYSAYVNSFNSGEKSRRNYKERKQEDLYNSIKKLLKSIDNVCDTDIEYIKNEIEKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERIAVALKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECSSKDNKYQYNLGNMYKWDVKRDGKTAWIAAKEGETGTLATVKKMLSRNTPILTRLAIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3366 - protein, 1356 aa, Unknown
  Description of Unknown: uncultivated organism sequence
  Category: MG91 effectors
  Description: MG91-558 effector
MGRDYYLGLDMGTSSVGWAVTDEKYNLLRAKGKDLWGIREFEEAEGGIARRQNRISRRRRQREQVRIGLLKSYFAEEIEKGDPDFLQRLENSKYHLSDKDEKVRYKSAIFNDPEYTDKDYYRDYPTIFHLRAELIHNQEPHDIRLVYLALLNMFKHRGHFLNASLSAEEETQSMSDAYTAFRALVEEVMTANETENLFFPDGKADEIEAIISSRDYNRKRKSELMTEMLGFTKKDKAAQALIKGMCGLTVDVKTVFREIESEAKLSISFSDSNYDEKIVEIQEVLDDEQLELLEAVKTIYDIGSLAGVLKGEKYLSDARITDYNKHKEDLALLKKIIRKYTDQKTYNDLFRGTEPGSYSAYVNSTNSGKKQRRNMGGNAKRNQEAFYASLKKLLNKLPSEDDDVQKILADIDKELFLPKQLTFANGVIPNQVHAREMKAILNNAEQYLPFLTEKDESGLTVSERILKLFSFQIPYYVGPVTTKSSRDGGNGWVVRKESGQVLPWNIEDKIDMDATSKKFIENLIRECTYIAGEKVLPKGSLLYERYCVLNEINNIKIDGRPIDVELKQKIFEDKFMSGKKVTRKQLVTYLHGKGVLEDDAQLTGIDKTINNSLSSYGKFLGVFGDELKKDSCQIMVEDIIRDCTIYGDSKKRLRETLQKKYVDNNNLSESQLKRILGFKFKDWGRMSKEFLEMQGINRETGEVMSLVQAMWETNLNLMELIYSEDFTFAEALQEKQAKDYLTLSEFKFEDLDEYYFSAPVKRMVWQTLLIIKELEKVLGAPPKKVFIEMTRSDGVKGDRGRTISRKKQFEDLYKKIKDESQDWASIIDNADASGKLRSKKMYLYLTQMGKCMYTGKPIDLDDLFDDNKYDIDHIYPRHYVKDDNLGNNLVLVEKKANASKGDRYPLDTDIRGKMHGTWKFLKEKGLITEEKYRRLTGSNPFSEEQQADFIARQLVQTSQGTKGVADLLKQLLPDAKIAYSKASNVSDFRRDYDLPKSRLINDFHHANDAYLNIVVGNAYLVKFTQNPLNYIRSGDVQYNLGRMFEKDIVRNGEVAWLADDGKGNHGTIVTVKKVMARNTPMMTRMVLNGHGAIANATLYPASKASADNYIPLKGSDSKIADVTKYGGFTSVSTSRFVLVEHLVKKERIRTLEALPILVANSCKTMEDIENYCEEELGLIAPKVKLDGIKIQSLLKINGFYVHLSGKTNKQLALRNAVNLCLDAKWKEYIHYLEKASNNGNYGNPICSDMNIELYSILAEKHSSSIFAKRPNPVGTKLVKEKETFSKLELVDQVSVLLQILQLSAIGITQADLRAIGGAGIAGKMLISKDISKQEEALLIMQSPTGLYESTIDLKTI

SEQ ID NO: 3367 - protein, 530 aa, Unknown
  Description of Unknown: uncultivated organism sequence
  Category: MG91 effectors
  Description: MG91-559 effector
MKNSSIIVSYEITLPQRIYPHLDRLFSVFGRNVRYFIDKLWNDDTLKLINQNGYAVSILKEIIQKPKDLPSRVFRNVLELSGQILRSQIERRRLFDKLIQKPCILIQSDREIAKFLNTSIPFALNVKRQVLKVLKKGEKRDYLSLIKPSFSNTVVITSADDNLKNGQFKKLKIDKNKLTLELKVPVGNNWEWIKVEKFLTNRLKKALKNAKEVKAPLIKKVDLKSGFSVYRLVIPIEIQTKVKDKVERIFALDLSSSEKRLGVGVIVDKEGHSKPVFFNAFKMVRKLERLYKEISSLERKIDHIADGLHSTVKKKHRERLYIRLRHLYQEQKLRWRKFKELRKQILETFTNLIIAHTKAYSCDAITIEDLKFQDLPEWKNRRFRRLFSTWFYSRFENRLRHKAQREGIKILTVNPFNTSQVCHRCGSKCKADRLEFKCESCGKHFDRDYNASVNIGMKALNLACKTKSKSYMDKDTPARFPSLQVLTRYKFKSLLTFLPLLKLIAYLRLVETSYLKLKNLFKYVNSDKYG

SEQ ID NO: 3368 - protein, 525 aa, Unknown
  Description of Unknown: uncultivated organism sequence
  Category: MG91 effectors
  Description: MG91-560 effector
MNEVFVLELPLQVEKYQADILNKRYEQLRQLYNYVQGKLLRQYRYFEQMKEYQACKTFKEKKDFFRSHPFHINGVFGSNKKLFNITFDEYGINGFVEKLGKKQVSTGVTYADLGITSTLLDRLSLAIWAAWDKMLYNYHAQRVSFKKRGELNIFGSRKKTNGSGKKMFSGMELHLDKMEVAIKLNGKVGKAAKFMTLPILPNPKHTDYEMWALKGGFDSVTVITIVRRLVRSQYKYYVQLTIEGEKPQKGRTLGKGRVGIDLGPTTVAISGENIVSIDKLAAKCDNIQEEITRLSRKIDRSRRANNPQNFNEDGTIKRGIKLVWNDSKRYKELRRELAELLRKQAAIRKQQHIDRANALLKEGDTFIVENNQISGWTTRAKETKVNEKTGKIQKKKRFGKSVANHAPSMFVSILENKVKSLGGEVVKVDTKNAASQYDFTDGSFTKHELKERNVTLSNGNTHQRDMLAAFNLQHLKYNEPEAKQYDTEAMAADYERFCQLEQEEIQRYKNKEKKDDRGTIGAEKL

SEQ ID NO: 3369 - protein, 632 aa, Unknown
  Description of Unknown: uncultivated organism sequence
  Category: MG91 effectors
  Description: MG91-561 effector
MTSQSFVIELPIAVDDAEMRTIVRKLEFARQLHNATLGTAIGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRQEKKVLNWCGHDYRVLIDPKDNYVQRALKENERSDQYRKIKYCRLVRKRIRSADRFFLQVVIEGTAPVKHVYAPVTERAAIDPGPQSITLFSKAFAGKIQVAGSNNFNEAVSRRLLRAMDRSLRRNNPDAYNEDGTINKGAKLAKSKNYQRKVDQLHEMHRVAAAQRKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVVQKFDDRSEGLDMQTVYLSAGYTMGPHYFAGSIGWLNAELNGSAEGYPQDDGAAFLGALVYYYSLSKRTQLYAFTSFVDGKQLLDAGTDFNQTTGGFGLMHKF

SEQ ID NO: 3370 - protein, 413 aa, Unknown
  Description of Unknown: uncultivated organism sequence
  Category: MG91 effectors
  Description: MG91-562 effector
MKENGFSQYGLDAFFKADTKGALYQCGLNSMFLQYLSQCAWSAWDKKLFGKGDFVKTDKVVNIFCSRNKKERFCGFDYDLSTFTISIQSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKVYNETRKQLADAQRKLAAKRKIAHNELANTLLEYGDTFKVEANSYKSMQARAKATSMTKSGRIRSKKRYGKSINNRAPSEFLVILKNKLLYYPKGKYYDVPSSYACTQFDFTNESFTEHKISERRIVTSDGIQHNRDTLAAFNIKNAIVNDTSTKKKKVTKSKEFFDIVRMKASYNEFCLMERYLLSV

SEQ ID NO: 3371 - protein, 534 aa, Unknown
  Description of Unknown: uncultivated organism sequence
  Category: MG91 effectors
  Description: MG91-563 effector
MRTNSLILSYELTLPQRIYPKLDRLFSVFKWKVRDLISDLWNEKGFKLLKEKGSAWGILKNVIERPLNLPSRVHRNILELSGQIIRSHLERKRIFDYIIEKPYRVLCDEKDIAKDLNTSSLFVLNVQNQIKNLLQKEKEKKDYFSVIEPSFSGNVIITSADDNLEKGQFRRLKIQRNKITFEIKVPTFEGWEWIRVVKFIPDKLRKVLSRAKDIKAPLIKRVFLKSGFTIYRLVIPVEIEVKVEERIERVFAIDLSPSEKRLGVGVVVSESGYSKPVFFSAYKKIKKLERLYREISNLERKIDNIGDQIHGTLKREHRERLYQRLEHLFEEQKLRWRKFKELREQILEIFVNFVIEHAKGYCCDAIVIEKLEFKGLPAWNNKRFRRLFSLWFYSEFSKRLEHKALRNGLRVIKVDFHRNSKICHICGSEGRVNKLEFYCPKCQRRFDRDYNGAVNIGMKALMVCRTKPKPYMGKGIPVRVPFPQVPTHSILPFKFKALLFTISFLRLLSYLRVVETSYLKFGRLTGLVGSDKYG

SEQ ID NO: 3372 - protein, 534 aa, Unknown
  Description of Unknown: uncultivated organism sequence
  Category: MG91 effectors
  Description: MG91-564 effector
METNSLILSYELTLPQRIYPKLDRLFSVFKWKIRDLISELWNEEGFKLLKEKKSACSILKSIIERPPGIPSRVYRNILELSGQIIRSHLERKRIFDYIIEKPCRVLCDEKDIAKDLNTSSLFVLNVQNQIKNLLQKEKEKKDYFSVIEPSFSGNVIITSADDNLEKGQFRRLKIEGNKITFEIKVPASEGWEWIKVKKFIPDKLRKVLSRAKDIKAPLIKRVFLKSGFTIYRLVVPVEIEVKVEKRIERVFAIDLSPSEKRLGVGVVVFESGYSKPVFFSAYKKVRKLERIYKEISNLERKIDNIANQIHSTFKKKHKAQLYQRLKHLYQEQKLRWRKFKELREQILEIFVNFVIEHARGYGCDAIVVEKLEFKNLPTWNNKRFRRLFSLWFYSRFSKRLEHKALRNGLRVIKVDSCGNSKICHICGFEGRINKLEFYCPKCQKRFDRDYNGAVNIGIKALRVCRTKPKPYKGKGIPVRVPFPQVPTHSILPFKFKALLFTISFLKLLSYLRVVETSYLKFGRLTGLVGSDKYG

SEQ ID NO: 3373 - protein, 1371 aa, Unknown
  Description of Unknown: uncultivated organism sequence
  Category: MG91 effectors
  Description: MG91-565 effector
MSQLENNVTKSGYYLGLDMGTDSVGWAVTDDKYNILRAKGKDLWGMREFEEAQTAADRRSHRTSRRRYQREVVRIGLLKDYFHDAIAKVDPLFYQRLENSAYFLEDKDECVRNKNGIFNDKNYTDRDYYRKYPTIFHLRMELINNPEPHDVRLIYLALLQMFKHRGHFLNASLGNEGNEKEFSDLLREMGNTLADITGTSLADNVVAKDVELVLSKRELSRTGKSERLAELFSITKKDKVQFECIKGICGLSIDARKIFEPLENEDKKIEICFSSSGYDEKITDIQGAVGDENYALIEIMKSVYDAGMLAGIMKGKHYLSEARIEDFEKHKKDLSVLKKVIKKYKTDEYDSLFRSEANGSYSAYVDSFNSGVKQRRDMKERKKEDFYKTVKTLIKDMPSDDKDIKYINNEIECDNFMPKQMTSSNGVIPNQVHLFEMKKILGNAESFISFLKEKDESGYSVAERIIKLFAFQIPYYVGPVSEDSGRNGGNGWVVRKEKGKVLPWNIDEKIDMRKTSEQFISRLVRKCTYISGENVLPKESLEYQKYALLNEINVISVDGERISTELKQKMYKELFMSGKSVTRKKIVSYLHNEGILSDETQLSGIDEKVNSNLSSYSKFKSVFGDKIDQDRYQEIAEQIIFWCTVYGDDKKYLSEQLEEKYKDELTDDQIKRITGFKFKDWGKMSKAFLELPGCDKEDGEVVPLVRMMWNTNHNMMELINSEEYTYKDELFAKQRRAINCISELKLEDLDEMYFSAPVKRMVWQTLQIITELEKVMGTAPTKVFVEMTRKHDDNKKRTQTRKDKFLDLYRSVKNDEHNWSQIINTADSDGTIRSKKMYLYLTQKGRCMYTGRPIDLDRLFDDNLYDIDHIYPRHYVKDDNIDNNMVLVEKEKNAHKSDIYPVESSIFSNCVNMWKELYNGKFISEEKFKRLTGREPFNDEQKAGFIARQLVETSQGTKGVSDIIKEALPDETRIIYSKASNVSEFRQEFTIPKSRLINDFHHAHDAYLNIVVGNVYETKFTQNPMNFIKTDYRKDQERNKYNLSRMFDWNVSRGLYTAWTASINSKKNRIDHNIENESGTICTVRKMLKKTTPILTRLSYVGQGGLANATVYSAKKASAGKGYLPLKTEGRLSDVSKYGGVTNASVEYFFLVEYEEKGKKICSLETVPVYMAGKVGKDKVKLEEYCRDILHLSNPSVRVPQIKLASLVKVDGYLLHITGKTGNQICLRNAVNLCEDVETVRYLKKLENSENKGYLEEEITEDENIKLYQNFMDKHINSIFRLRPNPVGDKLLEGFDRFKSLSVEEQTKVLLQMLNLTGIVAGCAADLTAIGESKATGKMLIPQKIIKFKEIKLINQSVTGLYDKSIDLLTV

SEQ ID NO: 3374 - protein, 510 aa, Unknown
  Description of Unknown: uncultivated organism sequence
  Category: MG91 effectors
  Description: MG91-566 effector
MRKKTTDENFIMELPLTVEKFQSDELDKRFELMRRIYNSAQNKLKRQYEYLSSFKAYKECKTKKEKGDFLKSHSFSFKGVLDKGGEPLKITFSEYDLKSYLSKFAKIKVDSQYTYSDYGINTSMLMHMAMAIWSAWKKVLYDPKAQEVSFKKHGELQSIGVDWEPKHPAGLILDLQKGELKVNLNNRQGHYARYITMKIKFGRKERQAWYEGDALNAGEDSIRGLTIVRRKIRGKYNYFLQMTIRNNKPQKGRTLGTGRVAIDLGTCKVAVVTKDSVRLIPLAPNISSYSEELRIIQRQMDRSRRANNPQKYHEDGTIKKGNHDKWVSSKEYIRLRDIKAELERKQAAVRKQDHIALANYLLSLGNEFVIENNDVQEWAKRKKEEKRREKDGKILSKAGLGKQIGNHSPAMFVTILKNKVESLGGSFIKVDTDNGATDYDFTNDEFTHHELEERYITLSDGKRHQRDTLAAFNLYHIDTTQNRVYDRLAMQRHYAWFCEREAEAVERFKR

SEQ ID NO: 3375 - protein, 530 aa, Unknown
  Description of Unknown: uncultivated organism sequence
  Category: MG91 effectors
  Description: MG91-567 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRFKLGLGGMPRFKSSKRGLHSIEGKTNKTGLKFRPEKKVLNWCGHDYRVLIDPKDDYIQRALKENERSDQYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAASAGLKVTEVNPYKLKLSQYDPYTDTYRKKDLSERWQEMKAGSGQYIQRDVLSALLLYCANIEKEIHIPKVAVEQLEGAKQFLTDAGYVVLKSTSSRDQRDPRLASEPKAMTPEMARQKILRGAGDSHLPTDQELGRIRAGGKVSTWSKETFPLQRGVV

SEQ ID NO: 3376 - protein, 618 aa, Unknown
  Description of Unknown: uncultivated organism sequence
  Category: MG91 effectors
  Description: MG91-568 effector
MAKENFVLTLPLKVEKWQADILDKRYELLRQIYNMVQQKLLRQYIYFSQQKAYRVCESFQQKREFFASHPFHIKGINTKNGEPFDIKFPYTYESRSSGTGKRPSNGISDYVSKLWSHSVGQNTTLSNLGINSYILEELGLHIMGAWEKRLYDPKSSHVSFKKYGDVNSFGSRYKKDKKSNRITLPGFTINIKEGYITYNANGRQGQFADLIRLSIDFSREKKGYATEALKGGLDSVRKLIIVRRCIRGKNKYYLQLTIEGDKPQKGRVLGKGNVGIDIGPSTIATSSLLGVHFDKLADKCDNIEHELYLVGRKMDRSRRANNPQNYNEDGTIKRGVRLVWKKDKDCKRYANLKQVRKELYRKQAEIRKHQHLEMANALLSQGDTFIVENNPIDAWVRRAKETTKTKTGKNRCKKRYGKSVANHAPAMLVSILKNKVQSLGGQFYEVDVRYAATQFDFTNGVKTKHDVSERSITLSNGRTLQRDMLSAFNLQHINQESIGTNDYAYNIEQMQADYPIFCRLESAERNRFKVARHNERDAQYFVGESKKILRLQPQKDTAANRHNGGVDRKHCNTCLGSKTKENAEITGSGLVRESIERVSQVPDEYHPVDTNSIILDGL

SEQ ID NO: 3377 - protein, 555 aa, Unknown
  Description of Unknown: uncultivated organism sequence
  Category: MG91 effectors
  Description: MG91-569 effector
MAGGIRATTRLMLYHRNMTTQTFILELPIKADDSQSRTISKKFEYGRMLYNATLGSGLGRLTQMRQDPEWRCACEMSKGKERNELFRRLNRQYRLTEYDFHSDIARHREGTKRKSELGICEAQKLATQAFNAVSRYMFKQGGRPRFKSFKRGLHSLEGKTNTTGLKFKPEKMLLDWCRKTYQVMLDPEDTYALEALYADKERTKFKRIKYNRIVCRNIKGVKRFYLQVVLEGTPPVKHAYAPASERMAIDPGPKAFAVFCPRVQAKVQIAPQAKVNEKAIRRIQRSMDRSLRAKNPNAFDEKGRIKPGVSLAYSKGYQARLTKLREAHRKVAGTRKCEHGELANLLLECAGNIRIEKNSWEAFKRSHFGRSINNSAASGFIQKLKSKAERAGLTVEEVSPYRLKPSQYDPYKDEFVKKALGERWMYLGDESTVIQRDIMSAILIYFADLKNQTHNPEVVKTNLEGLKRGLTDAGYVKHLKLPRSSGSKDPLFAPEPKALTTEELRSKCFRVDSDRHSSTINGTDGKAVGWSETFPLTGELFRDSVLSSVSARGAS

SEQ ID NO: 3378 - protein, 530 aa, Unknown
  Description of Unknown: uncultivated organism sequence
  Category: MG91 effectors
  Description: MG91-570 effector
MTFQSFVIELPIAVDDAEMRTIVRKLEFARQLHNATLGTAMGQLQQMRQDTAWKQACAMPKGKERTAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDLLSALLLYCANIEKEIHIPKVAVEQLEGAKQFLTDAGYVVLKSTSSRDQRDPRLASEPKAMTPEMARQKILRGAGDSHLPTDQELGRIRAGGKVSTWSKETFPLQRGVV

SEQ ID NO: 3379 - protein, 1365 aa, Unknown
  Description of Unknown: uncultivated organism sequence
  Category: MG91 effectors
  Description: MG91-571 effector
MKKDSMEYYLGLDMGTNSVGWAVTDTNYKLLRLKGKDAWGIREFDEAKTSEDRRVNRISRRRREREKVRIGLVKDYFSDAIHAVDPNFFMRLENSKYYLEDKDEDVKTPNAIFDDPDYTDKDYYDAYPTIFHLRKELIEDKKPHDVRLVYLAVLNMFKHRGHFLNSGLSTDSDNNIKIDGAWEDLNKTYEELYGEELAVVNCDELLSVLSDRDKSRSAKLEQLLEILQINKKTDKQKAELIRLICGLKSEAKKVFSDIETEEKVEICFTDIAYEEKLPDIAEAVGEENIALIQAAKTVSDIGVLAGILHGDDYLSFARVKTYEKHAEDLKRLKRVIRKYGDEAQYDSLFRSEEDGSYGAYVNSFNAGKKQRRSFKKRTMDEFYKTVKTVLSKLKGASDDPDYQIIEKDIENETFMPKQLTSANGIIPNQVHCRELKVILKNAEGYLPFLLEKDEGGRTVTDRICALFSFQIPYYIGPVSEQSEKNGGNGWVVRKEQGQVLPWNLEEKIDTAATSQRFIERMVRRCTYISDEMVLPKASLEYERFMVLNEINNLRIDGEKIPVSLKQEIYHELYEKGKRVTRKQLVSYLTNRGCIENEEQVSGIDITLHQYLSSYGKFYPIFGDDMKTDACKSMVEEIIRLATIFGDAKHLLRKQITEKYGDRISDPKILKRILGFKFKDWGNLSKRFLELEGCENGVGEIVPLIDMMWQTEFNMMELLNSPRFTYRQTLEEYQQKGLKPLTEWKAEDLNDYYFSAPVKRMVWQTLKIIKEIEMITGSAPKRVFVEMTRKPGEKDKRTDSRKKKFLELYKNIVDEDADWRKHWEGVISKADEDGSIRSKKMYLYLTQMGRCMYTGREIDLNDLFDDNLYDIDHIYARHYVKDDNIANNLVLVYKPENARKTDNYPIDSDIRSKMSGYWSLLHRRKLITDEKYRRLTGRNPFTDEQKADFIARQLVETSQATKGVTEIIKGVFPPEQTTIVYAKASNVSDFRHKYQIHKSRLVNDFHHAHDAYLNIVVGNVYYVKFTQNPLNFIKKEYAMDQEKHRYNLEKMFVWDVKRGDEIAWIGNGKDDKNTQGSLVTVKKMLAKQTPILSRMPITGHGGIANATLYSAKTAKDTGYMPLKTSDPKMQDVTKYGGYSTISRAYFFLVESGTEKKRIRTLETVPVYLVEKLQTKEVLEEYCRNQLKLINPSVRVSKIRLQSLINLNGYYVQMTGVTGKQVILRNAVSLVLNDDEMFYAKKIEKADNGSFEENVITKEKNVAFYDALARKHMETIYSLRPNPVGQKLEKARDLFVELSIEKQCAVLYQILNLSIIGPVKADLTLIGESKNTGVMLTSKNITKNKTFELINQSVTGLFEERVDLLTV

SEQ ID NO: 3380 - protein, 1352 aa, Unknown
  Description of Unknown: uncultivated organism sequence
  Category: MG91 effectors
  Description: MG91-572 effector
MLEKPYYLGLDMGTNSVGWAVTDQHYNLLKAKGKDLWGIREFIEADTSVERRTHRISRRRRQRERARIGLLNDYFHDAIIAIDPSFFQRLENSKYHLEDKDQNVRYKYNIFNGPDYTDVDYYAQYPTIYHLRKELLENPKPHDVRLVYLALLNMFKHRGHFLNAGISDGNNEHSLKDAYINFAISVSELTEDYFNQDVDYSAIEGILSSRDLNRTKKAEELSTVLGIDFKDKKYKEYLRAICGLKINAYTLFSDQLPNDTTKIDLCVSDASFDEKSEELVSLIGEDLFQIILNIKEIYDIGSLAGILKGYTYLSQARVAAYDKHKHDLKLLKTSIKKYCTKEEYNNFFNSDADGSYASYTGSFNSGNRERRVGSKRTSEDLYKEIKKLLKDASKNDPAINEIFTSIETESFLPKQLTASNGIIPNQVHSKEMAKILANAENYLPFLKDTDENNLSISNRILQLYKFQIPYYIGPVTEKSQRDGGNGWVIRKDNGRVLPWNIEEKIDVKATSEAFISRMVRRCTYMNGKQVLPKASLEYESFRVLNEINNLRIDGERISVALKQDIYTDLFQKGKKVTKKQLCNYLVTRGLIKSSEQVTGIDIAINNSLSTYGKFKAILGEDIKLDHIQHMIEDIVFWCTVYGDSKQFLKEQIEDKYNGKLSPEQIKRILGFKFKDWGNLSKEFFELKGADKSTGQAISIIRALWENNLNLMELINSPEFDFKERLADYEVNSLKTLSDFEPEDLNEYYFSAPVRRMIWQTTLIIKELVHVLGKEPDRIFIEMTREKDASRGRTLSRKKKFEDLYKNVKDENNDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKIVYAKAGNVSDFRRNRELPKSRLVNDFHHAHDAYLNIVVGNVYYMKFTQNPINYIKNSYNKDMNKNNYNLSRMFDWDVKRGDEVAWIAQKKDSATGTISTVKKMLSKNTPLMTRLSYEGKGALANETLYSAEKAKGEGYIPFKSSDAKIQDVTKYGGFTSVTGAYFFLVEHDEKKKRIRTIESVPLYLADKIEKDSSELERYCDKLGLVNYDVRVRKIKIGSLIKYNGYFCYITGKTGYRLIVRNATNLCLASNWTKYIKKIEKYKETTIIDNVITAEENIKLYNELLNKFTVGIFGRRPNPIGEKMDSARDKFASLSTENQCLALYQILQLSAILGNESDLQLIGSSTHAGKMLISKKIGTDEIYLINQSPTGLFETKIDLQTI

SEQ ID NO: 3381 - protein, 1127 aa, Unknown
  Description of Unknown: uncultivated organism sequence
  Category: MG91 effectors
  Description: MG91-573 effector
MNMSKRILSLDLGITSIGYSILNEMDSNKYGLVDYGVSMFDKATDKDKKSKKLLHSASKSSSKLYDLRKERTRNLANLFEKYNLGSASELLNQEKQNRFINKWYLRAEKSFSERLTIEELFSIFYLVAKHRGYKSLDTDDLLEELLIELGFKVEEKKEKDAEKGKVKQALKTVESFRKKYPEKTVARIIYEIEIQKENPTFRNHDNYNYMIRREYINEEIRKIVQAQDEFGLFDAGIDIELFIKELIDTVDDQKDSTNDMSLFGNCEYFPEHKVTHQYSLLSDIFKMYQSVANITFGKTKISKEQIETIVNDFFKKIKLGKNIADIKYQDIRKVLKLNDEVKIFSKEDYHLDKKGKKIHSTITKFHFLSSLGKIGKSFIESIFEKENKFEILKEIFDVLEFEKAPKSMYNQINEIFIKYTLVEDEKLKNETIINLIKHKSGNSLNISAYTMIQFIPYFERGMTTDEIKQELKLERNEDYSTYKKGIKHLHVKTFEKDDNLEINNHPVKYAVSATMRLVKHLHVTYGVFDEIRVESTRELSQNEETKKAIEKANKENQAKFQKIIDNEEYQKIANHYNKNLKRYARKIMLWEEQEKLDMYSGEVISFNDIFSNKVDIDHIIPQSLGGLSVKHNLVLAHRDENHKKSNQLPMHFVVDTVDYVNRVEHLFKEYKINWKKKINLLAETLDDRYKDTFESKELRATSYIEALAAQMLKRYYPFPDKEKQANGQAVAHVQGRATSNIRKLLGVKTKVRDTNIHHAIDAILIGLTNKSWLQKLSNTFRENMGVIDDKARANIKKEIPLIEGIEPKELVELIEDAYNIYGEDSVFYKDIFGDTKVVNFWVSKKPMSSKIHKDTIYAKKPNGLFTVREGIIKQFIALKTTVTTDPEQFMKNFEKKILQKMYLFMTNPNDVICKIVISRAEEINLLLQSFVNIDRKNKEDMSEAKEKLDKLMHKELLDNNDNVIRKVKFYQSNLTGFDIRGGLATKEKTFIGFKATLENEKLVYERIDASNFKRIQKENDGSFKVYKNDIVFFVYPDGSFRGGKIVSFLADKGITAFLNSKFPSASELQPKSFCKMDKGKKSGAKQQSINKSIGIIKLNLDILGNIKSYSNFGEVSKEVELKIFHKE

SEQ ID NO: 3382 - protein, 533 aa, Unknown
  Description of Unknown: uncultivated organism sequence
  Category: MG91 effectors
  Description: MG91-574 effector
MSHSYILSFELTLPQRIYPYLDRLFNVFKWEVRRTVRKIWNEDFFEKLKGKGSASSILTKVLERPSNIPSRVYRNILELSGEIIRSHIERKRIYDYLIDKPCRVLFDEDEIADKLDTSSLFVLNVKRQVRKILKKEKEKKSYFETVKPYFKGKVIIFSADDSVENGQFKKLRFTEKYLELEIKVPDGNLWKWIKVKKFIPDRLKKFLPKAKRTCAPIIKKVYLKSGFYIYRLVIPFEFEVKFSEKNFRVFAIDLSPSEKRLGVGAIVTPEAHSRPLFFSAEKMIRKLERILKEISNLERKIDNIANEIHVTGNKEHKRRLEKRLKHLFVEQKLKWKKFTELRKQILEVFTKLILEHARAYNCSFIVVERLKFSKLPDWKHPRMKRFFSQWFYLRFVERLKQKALRYGIKVFLTNPCRTSRICHRCGKAGLLEKLEFLCECGIYDRDYNASVNIGKKALQILMSGAKSEPYMGEDTPGRFPFPRVPAHQVLPYHFRALLFLITLTRLISYLRIVETSSLKLKNLIRWTGSDRYG

SEQ ID NO: 3383 - protein, 994 aa, Unknown
  Description of Unknown: uncultivated organism sequence
  Category: MG91 effectors
  Description: MG91-575 effector
METLRKEYPEKTVARIIYEIEIQKPNPTFRNHDNYNYMIRREYIREEIEKIVLSQMDFGLFAKTFDVDTFIKELISTIDDQKDSTNDLSLFGNCEYYPEEKVAHQYSLLSDIFKMYQSVTNITFGKTKISKEQIKIISDDFFKKIKQSKNIADIKYQDIRKLLKLKDEVQIFGKEDYRLDKKGKKVHYTITKFHFLANLGKIDNSFMDAVFEKKNKYEILKEIFDVLEFEKAPKSMYTQINAVFMKYTLVEDERLKDETIINLIKYKTGSSLNISAHAMIKFIPYFEKGMTLDEIKKELNIKNFEDYSEFKKGIKYLGLGIDKKLFVTVEARDRIKKYPASQFEFDNQLIINNHPVKYVVSATMRLVKHLHVTYGAFDEIRVESTRELSQNEETKKAIDKANRENEAKFQKIIEDEEYQKIAKHYNKNLKRYARKIMLWEEQDKIDIYSGKVICFEDIFTNVVDIDHIIPESLGGLSVKHNLVLAHRDENVKKSNQLPMNFVTDKVAYVNRIEHLYKEYKINWKKKINLLAETLDDSYKDTFESKSLRSTSYIEALTAQMLKRYYPFPDKKKQVNGQAVAHVQGRATSNIRKLLGVKIKVRDTNIHHAIDAILIGLTSKSWLQKLSNTFRENMGVIDDEARAKINKELPLIEGVEPKELVELIEDAYNVYGEDSVFYKDIFGKTKAVNFWVSKKSDTSSLHKETIYGIDKIKGKIKDKQYTGLTTLRIDIIKRLKDAQKKPTLPKIGDDAHMFLNEYQEELIKKLYVYQYNQEDKILAIIQAKASDIAKCLEKYSDIKNENKDLFSKAKEELSCIIDKPLVDYNGNIIRKVKIIVSNKEKEPMIRGGTTVAERIAIGFSVYTLEKDKLLFRRIDLKDKLSKSLTKVNASSSMNIFRNDLIYIIFKKSEKNLVGYLESFDDKTNKIRLYDARFPKRLELQPKKYKVSSGKSRKEFGVGSAMGFIKINLDILGNIKSHTRFGEVSKEVEAQIFHKE

SEQ ID NO: 3384 - protein, 1358 aa, Unknown
  Description of Unknown: uncultivated organism sequence
  Category: MG91 effectors
  Description: MG91-576 effector
MQETGKDYYLGLDMGTNSVGWAVTDENYVLMRAKGKDLWGIREFDEALTAVDRRTHRVARRRRQRETARIGLLKEYFHDAIAEADPNFYQRLDNSKYHEEDKDSAVKGKNGIFNDANYTDKDYFKQYPTIFHLRTELIESTEKHDVRLVYLALLNMFKHRGHFLNAGLSTESENTMDTAYHNFVETAAQTIECNFMETVDIEKIKEILGSRDYSRSKKAELVAQLLHVDSKNKVQMACIKCICGLKVTAAAIFGDKMAADEEKKTDICFSDFGYDEKVPVILETVGEENFELVLAMQEIYDIGSLAGIMKDSLYLSMARVKEYEQHGKDLKILKGVVKKYATKEEYDTLFRTMEEGTYSAYVNSVNTKKKSRRDVKKRTRDEFYGRLKKIISTMPQDDSDVLYIKDKMEKEAFLPKQLTASNGVIPNQIHAREMKKILQNAETYLPFLKEKDTSGLTVSERILKLFSFQIPYYVGPVSEKSKLNGGNGWVVRKEEGTVLPWNIEEKIDMTATSREFVERMVRRCSYLSDERVLPKGSLLYERFCVLNEINAIKVDGVKIPVEIKQDLYSKYFKKGKKVTRKKIAEFLIARGVIKEDQTELISGIDIAVNSTLSTYAKFYAIFGEKMEQDSYKKMVEQIVEWCTIYGDAKKFLEQKIKECYGNILTQEEIKRITGFKFRDWGRLSKEFLELSGCSKATGEVMPLISMMWETNDNLMELLDDNYYTYREALEEKQNNAFRLLADIEPEDLDEMYFSAPVKRMVWQTLCIIKELEKVLGKAPKRLFVEMTRNEQKDKKRTDSRKQQFLDLYKNIKDESRDWKELITRADENGTLKSKKMYLYLTQRGRCMYTGHPIDLEDLFKDNRYDIDHIYPRHFVKDDNIMNNLVLVEKEKNAHKSDNYPLEEEIYKKQLPVWKDLHQCKLITDEKFKRLTGRNEFTDEQKAGFIARQLVETSQGTKGVTTILERALPDTKIVYAKASNVSEFRQKRDLLKSRVVNDFHHAQDAYLNIVVGNVYFVKFTQNPLHFIKAEYDKNKAQYEYNLSRMFDRDVRRGNETAWIGCKKGEEAGTIVTVKKMMAKNTPMLTRLSFEGKGGLADQTLYSAEKAKGNGYIPLKTSDAKMQDVTKYGGFNSVSTAYFFLVEHELKGKKVRTLETVPIIWRDRIEKDETMLLKYCTDVLELKNPSIRVKKIKLQSYIKKDGYYMYITGKTNKQITTKNAVELCVNQRWIDYIKIIEKTVEKKKECEEVNYNKNVEFYDLLLTKHTQEIFSNRPNPVGAKLKQGRDKFLSLTLFEQSTVLYEILQLSIIGNTRADLHSIGGAPISGVMLLSKKITDSKEFILINQSVTGLFEQKVDLLTV

SEQ ID NO: 3385 - protein, 497 aa, Unknown
  Description of Unknown: uncultivated organism sequence
  Category: MG91 effectors
  Description: MG91-577 effector
MTSPTFIIELPIRVSDSESRTILRKLEFARQLHNATLGTALGQLQQLRQDSEWEKACLMPKGKERSELFRKLDRKYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNPDCYESDGTLRKGCVLKKTKGYEKRIQRLQECHRRAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3386 - protein, 497 aa, Unknown
  Description of Unknown: uncultivated organism sequence
  Category: MG91 effectors
  Description: MG91-578 effector
MTSPTFIIELPIRVSDSESRTILRKLEFARQLHNATLGTALGQLQQLRQDSEWEKACLMPKGKERSELFRKLDREYQLTEYDLHTVIAKHRQRSGRKTELGINETQKIATRVFQAVNRYKLGLGGRPRFKSLSRGLRSIEGKSNKTGLKFNIEKSVLSWCKHDYRVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNPDCYESDGTLRKGCVLKKTKGYEKRIQRLQECHRKAAATRQCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3387 - protein, 529 aa, Unknown
  Description of Unknown: uncultivated organism sequence
  Category: MG91 effectors
  Description: MG91-579 effector
MNTPSFVIELPIRTDDHERRTIVGKLEYARCLHNATLGTALGQLQQMRQDPAWKKACRMPKGKERTNAFRALDRQYGLTEYDLHAAIARHRQGSGRKEELGINETQKIATRIFQAVSRYKLGLGGRPRFKSQSRGLHSIEGKTNKTGLKFKPETSTLDWCGHEYRVLIDQRDGYLQRALREEADPKRWRKVKYCRLVRRRIRGKERFYLQVVLEGTAPLKRVYAPVVERLAIDPCPQTVAVFCPRFAGKIEVAPHAKVDEAELRVLQRSMDRSLRSCNPKAYNEDGTIKPGVELVKSKGYLKRVARLQELYRKAAATRKCDHGQLINLLLCLAGEIRIEKNSWAAFQRSHFGKSLGRSGVAGCLSQLKAKAESAGLKVIEAAPYKLKLSQYDPYTDSFRKKQLNERWHRAGMGDEYIQRDVLSAALLYCADLETQSHIPKAALALLEGAKQLLKDAGYWVSKPTSSQDPCDPRFAPEPKALTPEAVRLEIFGGTGDSPLQPSCPNGSKGAEGKVSACSKETFLLQQGVV

SEQ ID NO: 3388 - protein, 484 aa, Unknown
  Description of Unknown: uncultivated organism sequence
  Category: MG91 effectors
  Description: MG91-580 effector
MAHKENQKAFVVTFPLHTEKWQEDRIDKMMRMLTTFYNDRQRKLVRRYIYLSHSKAYKEAKGKGVVAFKNYMKENGFSQYGLDAFFKADTKGALYQCGLNSMFLQYLSQCAWSAWDKKLFGKGDFVKTDKVVNIFCSRNMKGRFCGFDYDLSTFTIRIKSTCTKKIICTIPFVVNKNSEYELYALSQKICRIGIVRKLIRSKYKYYVQFTFDGVPYNKGRNIGTGIVGIDPGPSKIAIVSDEKVEIAKLAPGIEEDERKTARLRRKLDRSRRATNPHMYKEDGTIIKGQRQTYFSKVYNETRKQLADAQRKLAAKRKIAHNELANTLLEYGDTFKVEANSYKSMQARTKATSMTKSGRIRSKKRYGKSINNRAPSEFLVILKNKLLYYPKGKYYDVPSSYACTQFDFTNESFTEHKISERRIVTSDGIQHNRDTLAAFNIKNAIVNDTSTKKKKITKSKEFFNIVKMKASYNEFCVKERYLLSV

SEQ ID NO: 3389 - protein, 530 aa, Unknown
  Description of Unknown: uncultivated organism sequence
  Category: MG91 effectors
  Description: MG91-581 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDQYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLAPEPKAMTPEMARQKILRGAGDSHLPTDQELGRIRAGGKVSTWSKETFPLQRGVV

SEQ ID NO: 3390 - protein, 530 aa, Unknown
  Description of Unknown: uncultivated organism sequence
  Category: MG91 effectors
  Description: MG91-582 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRFKLGLGGMPRFKSSKRGLHSIEGKTNKTGLKFRPEKKVLNWCGHDYRVLIDPKDDYIQRALKENERSDQYRKIKYCRLVRKRIRSSDRFFLQVVLEGTAPVKHVYAPVTERAAIDPGPQSIALFSKAFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQKGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLAPEPKAMTPEMARQKILRGAGDSHLPTDQELGRIRAGGKVSTWSKETFPLQRGVV

SEQ ID NO: 3391 - protein, 529 aa, Unknown
  Description of Unknown: uncultivated organism sequence
  Category: MG91 effectors
  Description: MG91-583 effector
MSTPSFVIELPVRTDNGEQRTIERKLEYARCLHNATLNTALGQLRQMRQDPAWKEVCRMPKGKKRTDAFRALDRQYGLTEYDLHAVIARHREGSGRKAELGINETQKIATRIFQAVSRYKLGLGGCPRFKSFSRGLHSIEGKTNKTGLKFKPEEAVLDWCEHEYRVLIDQEDDYLQRALRDDSDPEKWRKVKYCRLVRRRLRGKVRFYLQVVLEGTAPLKHVCAPVTERLAIDPCPQALAVFCPRFAGKILVAAHAKLDETAIRVLQRSMDRSLRSCNPKAYNEDGTIRQGVELVKSKGYLKRVSRLRELHRKAAATRKCDHGQLINLLLSLGGEIRIEQNSWAAFQRSHFGKSLGKSAVAGCLSQLKAKAESAGLKVIEVAPYKLKLSQYDPYTDSFRKKQLNERWHRAGTGDEYIQRDVLSASLLYCADLETQSHIPKAALALLEGAKQLLKDAGYWVSKPTSSQDPCDPRFAPEPKALTPETVRLEIFGGTGDSPLQPSCPNGSKGVEGKVSACSKETFPLERGVV

SEQ ID NO: 3392 - protein, 500 aa, Unknown
  Description of Unknown: uncultivated organism sequence
  Category: MG91 effectors
  Description: MG91-584 effector
MTTPTFVLELPVKLGQGELAEVRKRFNYARNLYNATVGTALGQLQQMRQDPQWRQACSMPKGKERTTTFRRLDEKYRLREYDLHAIIAKHREASGRKHDLGINEAQKLATRVYEVVTKYKLGLGGKPRFKTQSRGLHSISGKTNKTGLRFKPEKSRLYWNSLEMFVEIDRKDRYIFEALHVDKDPSRFKRIKYCSLVRKVINGKERYYLQLSLEGQAPIKHIYAPQTERLAIDPAPKAITVFHKETVFKASIEVSVHAEKQKKLQKQMSRSLQLNNPDAFDENGTLKKGARLQVKSKSYLKKQTQLCEVHRRAAAARKNLHGQVSNLLLSLAGEIVLEKNSWKALQRGHFGKSLGKSGMGAFERTLISKAERAGCKVHLVAPYILKPSQYDPFKDAFEKIPLKQRWRRMDDKELIQRDMLSAVLLYCADLANERHNRTEIFQTLEGAKQLLSDGGFVVKENPTSNPALDPRFAPERKAQAIEEVRREILCGCKGQLNANR

SEQ ID NO: 3393 - protein, 529 aa, Unknown
  Description of Unknown: uncultivated organism sequence
  Category: MG91 effectors
  Description: MG91-585 effector
MSTPSFVIELPVRTDNGEQRTIERKLEYARCLHNATLNTALGQLQQMRQDPAWKEVCRMPKGKKRTDAFRALDRQYGLTEYDLHAVIARHREGSGRKAELGINETQKIATRIFQAVSRYKLGLGGRPRFKSQSRGLHSIEGKTNKTGLKFKPETSTLDWCGHEYRVLIDQQDGYLQSALREETDPKRWRKVKYCRLVRKRIRGKERFYLQVVLKGTAPLKRVYAPVVERLAIDPCPQTVAVFCPRFAGKIEVAAHAKVDEAELRVLQRSMDRSLRSCNPKAYNEDGTIKPGVELVKSKGYLKRLARLQELYRKAAATRKCDHGQLINLLLSLGGEIRIEQNSWAAFQRSHFGKSLGKSAVAGCLSQLKAKAESAGLKVIEAAPYKLKLSQYDPYTDSFRKKQLNERWHRAGTGDEYIQRDVLSASLLYCADLETQSHIPKAALALLEGAKQLLKDAGYWVSKPTSSQDPCDPRFAPEPKALTPETVRLEIFGGTGDSPLQPSCPNGSKGVEGKVSACSKETFPLERGVV

SEQ ID NO: 3394 - protein, 530 aa, Unknown
  Description of Unknown: uncultivated organism sequence
  Category: MG91 effectors
  Description: MG91-586 effector
MKNSSIIVSYEITLPQKIYPYLDRLFSVFGRNVRYFIDKLWNDDTLKLINQNGYAVSILKEIIQKPKDLPSRVFRNVLELSGQILRSQIERRRLFDKLIQKPCILIQSDREIAKFLNTSIPFALNVKRQVLKVLKKGEKRDYLSLIKPSFSNTVVITSADDNLKNGQFKKLKIDKNKLTLELKVPVGNNWEWIKVEKFLTDRLKKALKNAKEVKAPLIKKVDLKSGFSVYRLVIPIEIQTKVKDKVERIFALDLSSSEKRLGVGVIVDKEGHSKPVFFNAFKMVRKLERLYKEISSLERKIDHIADGLHSTVKKKHRERLYIRLRHLYQEQKLRWRKFKELRKQILETFTNLIIAHTKAYSCDAITIEDLKFQDLPEWKNRRFRRLFSTWFYSRFENRLRHKAQREGIKILTVNPFNTSQVCHRCGSKCKADRLEFKCESCGKHFDRDYNASVNIGMKALNLACKTKSKSYMDKDTPARFPSLQVLTRYKFKSLLTFLPLLKLIAYLRLVETSYLKLKNLFKYVNSDKYG

SEQ ID NO: 3395 - protein, 495 aa, Unknown
  Description of Unknown: uncultivated organism sequence
  Category: MG91 effectors
  Description: MG91-587 effector
MAREKEDSGCFVVTFPLKTEKWQEDRIDKILNLLTVRYREKQKTLLDRYIHLSHSPEFKEAKNAGLKAFRDFMNEHKFTKYDVEKVFSDSSQSKSATTDIMLTHGINSVIMQELSHRAWSAWEKKLYGQGKFIRLDNEVNSFKSRLQGSNIIGFEYSFTDMTLSMKATKPKKHTMFTIPFIVNRKSEYEAYALGCEVRNIAIVRQQIRGKNKYYVQFSFAGTPYNKGRKMGTGIVGIDPGPSKIAIVSDSEIRITTLAPSVKRDERAIRRMQRKLDRSRRATNPDNYNDDGTIKRGIKLKFDKSNSYKRTQAKLADMQRKLAAKRKIDHNILANEIITMGNEFHVENNSFKSMQARSKETKKNDKGKNLSKKRFGKSLANRAPYELLTILKNKVCQYADGEYVDIPSRVACTQFDFTNGEFTKHDPEERIITTSDGLVHDRDALAAFNMRFVNRQRIEGKKKLEKDKENFDLQAMTEAYKQFCALEENIKIGKRN

SEQ ID NO: 3396 - protein, 490 aa, Unknown
  Description of Unknown: uncultivated organism sequence
  Category: MG91 effectors
  Description: MG91-588 effector
MARENENSGCFVVTFPLKTEKWQEDRIDKILTLLTVRYREKQKILLDRYIHLSHSPEFKEAKKTGLKAFRDFMNEHNFTKYDVEKVFSDSSLSKSVTADIMLTHGINYSIMQELSHRAWSAWEKKLYVQGKFIKLDNEVNIFKSRLKGSTITGFEYSFTEMTLSMNATKPKKHTMFTIPFVVNRKSEYEAYAMDCEVRNIAIMRQQIRGKNKYYVQFSFAGTPYNKGRKIGTGIVGIDPGPSKIAIVSDSEIRITTLAPSVNRDERAICRMQRKLDRSRRATNPDNYNDDGTIKRGIKLTFEKSNSYKRTQTKLADTQRKLAAKRKIDHNILANEIIAMGNEFHVENNSFKSMQARSKETKKNDKGKNMSKKRFGKSLANRAPSELLTILKNKVNQYADGDYVDIPSGVACTQFDFTNGEFTKHELKDRTITTSDGVVHDRDALAAFNMRFVQKKKVEGKKKIEKAKENFDLQAMTEAYKHFCSLEKNIK

SEQ ID NO: 3397 - protein, 524 aa, Unknown
  Description of Unknown: uncultivated organism sequence
  Category: MG91 effectors
  Description: MG91-589 effector
MNEVFVLELPLQVEKYQADILNKRYEQLRQLYNYVQSKLLRQYRYFEQMKEYQVCKTIREKREFFRNHPFNINGVFDRSGRLLDITFDEYGIQGFVEKMIHKSVGENTTYADLGLNTLILDYLSASIWRAWDKKLYDLKAKRISFKKYGELDSFSSRRKVVNGTARFFGVELYLDKMELAVKVNGKVGKNAKFITLKMLHNPKHADYEMWALKGGVDSVKVVKVVRRLVRSQYKYYVQLTIEGEKPQKGRTLGKGNVGIDLGPTTVAVSGENVVSIDKLASNCDNIQEEITRLSRKIDRSRRANNPQNFNEDGTIKRGIKLVWNDSKRYKELRRELAELRRKQAAIRKQQHIDRANALLKEGDTFIVENNQISGWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKLDETKTKQYDTETMAADYKRFCQLEQEEIQRYKNKEKKDDRGTVGAERL

SEQ ID NO: 3398 - protein, 1358 aa, Unknown
  Description of Unknown: uncultivated organism sequence
  Category: MG91 effectors
  Description: MG91-590 effector
MEKEYYLGLDMGTNSVGWAVTDDAYNLIRFKGKDMWGIREFDEANPAVERRTHRTSRRREQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKHFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILKLFSFQIPYYVGPVSSNSNGWGKRLESGQVLPWNIDKKIDLKETSEQFIQRMVRNCTYIAGEKVLPKASLLYENFKVLNEINNLSINDERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEMIPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKNGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKRYDIPKSRLINDFHHAHDAYLNIVVGNIYFTKFTSNPLNYIRKECSSKDNKYQYNLGNMYKWDVKRDGKTAWIAAKEGETGTIATVKKILSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGRTGNRFTLRNYVQLCLNGKWVDYIHKLEKYQDKGFIDNVITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3399 - protein, 524 aa, Unknown
  Description of Unknown: uncultivated organism sequence
  Category: MG91 effectors
  Description: MG91-591 effector
MNEVFVLELPLQVEKYQADILNKRYEQLRQLYNYVQGKLLRQYRYFEQMVDYQACKSIREKKDFLKNHPFHINGVLDKSGDQLDITFDEYGIQGFVEKLIHKSVGENTSYADLGFNTLILDYLSASIWRAWDKKLYDLKARRISFKKYGELDSFSSRRKVVRGMVYFSGMELHLDTMELAIKMNGKLGNNAKFITLKMLHNPKHAEYEMWALKGGVDSVKVLKVVRRLVRSQYKYYVQLTIEGEKPQKGRTLGKGNVGIDLGPTTVAVSGKNVVSIDKLASKCDNIQEEITRLSRKIDRSRRANNPQNFNEDGTIKRGIKLVWNDSKRYKELRRELAELRRKQAAIRKQQHIDRANALLKEGDTFIVENNQISSWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYDEKDTKQYDTEAMTADYERFCQLEQEEIQRYKNKEKKDDKGTIGAEKL

SEQ ID NO: 3400 - protein, 1136 aa, Unknown
  Description of Unknown: uncultivated organism sequence
  Category: MG91 effectors
  Description: MG91-592 effector
MSNKILSLDLGITSIGYSILEEMKNDRYSLLDYGISMFDKPTDKDGNSKKLLHSQSVSTTKLYDLRKERKQNLASLFEEFHLSTKALLLNQEKQNVYIQKWELRAKKAFEEKLEVGELFTIFYALAKHRGYKSLDSGDLLEELCVNLGIEREQSNNKKKDDDEKGKIKNALKTIENLRLDFPEKTVAQIIYETELQKENPTFRNHDNYNYMIRREYINDEIKKIIVFQKEFGFFSSNFDVEEFTSSIIATIDDQKDSTNDMSLFGFCEYYKDEEQKVAHQYSLLSDIYKMYESVSNINFNANPTIKITPEQIKLVADDFFTKVKKGKSIADIKYKDIRKILNLDDDFKIFNKDDSYSNKGKQQENRIIKFHFVNNLSKINNQFIVDIFEKENRYELLKEIFDVLAYEKAPHAIYEQLKDKIKDEKTIIDLIKYKSGNSLNISHYAMMKFIPYFEQGLNTDEIKEKLGLDRKEDYSSFKKGIKYLHINRFEEDDNLKINNHPVKYVVSATLRVIKHLHSIHGAFDEIRVESTRELSQNEQTKKDIEKANRVFEKELDAIVDDVEYQKIAEQYGKNLRKYARKILMYKEQEGRDIYSGEGIELKDIFTNIVDLDHIIPQSLGGLSVKHNFVLAHRDTNVQKSNQLPLNFVKEKQAFINRVEYLFEHHKINWKKKKNLLATTLEESFVDTFESKPLRATSYIEALTAQVLKRYYPFPNEKKESDGSAVRHIQGRATSNIRKLLGVKTKVRDTNIHHAIDAILIGFTNHSWLQKLSNTFRENMGVIDDEARSNIKKETPIIELIVNDEVEYLSPKELCEKIEESYNEFGEDSVFYRDVWGKVKVVNFWVSQKPMVSKIHKDTIYSKKRDSIFTVRENIINKFVLLKITSTTSSQKFMENFEKNILKKMYLFKTNPKDVICQIVQNRAKNIATLLDTFMEIDTENKEQISDAKGKLEQLMHKDLLDNNANIIRKIKFYQTNLTGFDVRGGLATKEKTFIGFRAWLEGENLQYERIDIANFDKIKKENDSSFKIYKNDVVFFVYADGSYRGGKIVSFLDYKGIASFSNSNYPALSEYQPKSFCKMGKDKHGNPKKSGAKQQTINASIGIIKLNLDITGNIRSYQVIGNVQSELLDFIKGIIK

SEQ ID NO: 3401 - protein, 507 aa, Unknown
  Description of Unknown: uncultivated organism sequence
  Category: MG91 effectors
  Description: MG91-593 effector
MKEQILSYELTLPQRIYPHLDRLFSVFKNQVNSYIPKLWNEKGFKLLSQKGSAVGILKKEFPTPEGIPSRVFRNVLELTGQIIRSQIERKEVFEKLLKGEEIKGYSKNFVLNIQRQIENLRKKGKEISCYFDLPHPKFNGQIVITSADDNLEKGQFRRLKISGNFLEFSIKVPTQKGWDWIKVKKLIPERLRRALTKAKEVKAVLIKKVLLKSGYHIYRLVIPLSFEVKEPENVERVLALDLSPSEKRLGTAVLVEGEKVSKPLFFKTQMLRKVERLHFEVSNLERKIDNIYNSIEKTACKREKERLWERLRHLFVEQKLRQRKIKQLRKEILETFTNLVIAHAKVYDCQAIVVEDLSFKEVPDWKDKKALRRFSQWFYSRFASRLEEKARLYNLKVIKVNPAHTSRICHKCGKEGKTERLVFKCSCGKYDRDYNASVNIAFRLTKPKAQRAEGIPGRFPSRLVQVEWKALLSFISFSKLLAWLRVVETSQLKLKKLLKRVYSDKYG

SEQ ID NO: 3402 - protein, 534 aa, Unknown
  Description of Unknown: uncultivated organism sequence
  Category: MG91 effectors
  Description: MG91-594 effector
METNSLILSYELTLPQRIYPKLDRLFSVFKWEVRDLISELWNEEGFKLLKEKNSACSILKSIIERPPGIPSRVYRNILELSGQIIRSHLERKRIFDYIIEKPCRVLCDEKDIAKDLNTSSLFVLNVQNQIKNFLQKEKEKKDYFSVIEPNFSGNVIITSADDNLEKGQFRRLKIEGNKITFEIKVPTFEGWEWIKVKKFIPDRLKKVLSRAKDIKAPLIKRVFLKSGFTIYRLVIPVEIEVKVEERIERVFAIDLSPSEKRLGVGVVVSESGYSKPVFFSAYKKIKKLERLYREISNLERKIDNIGDQIHGTLKREHRERLYQRLEHLFEEQKLRWRKFKELREQILEIFVNFVIEHARGYCCDAIVIEKLEFKGLPAWNNKRFRRLFSLWFYSRFSKRLEHKALRNGLRVIKVDSCGNSKICHICGSEGKVNKLEFYCLRCQRRFDRDYNGAVNIGIKALRVCRTKPKPYKGKGIPGRVPFPQVPTHQVLPFKFKVLLFTISFLKLLSYLRVVETSYLKFGRLTGLVGSDKYG

SEQ ID NO: 3403 - protein, 473 aa, Unknown
  Description of Unknown: uncultivated organism sequence
  Category: MG91 effectors
  Description: MG91-595 effector
MRQDPEWRRALGMVKGKERNELFRRLNRQYRLTEFDFHADIARHREGTKRKSELGINEAQKLATQAFNAVSRYMFKQGGRPRFKSFKRGLHSIEGKTNKTGLKFKPDQMILDWCRKTYQVMLDPKDAYALDALYADKERTQFKRIKYNRIVCRNIKGVKRFYLQVVLEGTPPVKHAYAPASERMAIDPGPKAFAVFCPRVQAKVQVAPRAKVNEKAIRRIQRSMDRSLRATNPNAFDEKGRIKPGVSLAYSKGYQVHLTNLREAHRKAAGTRKCEHGELANLLLECAGNIRIEKNSWEAFKRSHFGRSINNSAASGFIQRLKSKAERAGLTVEEISPFRLKPSQYDPYKDEFVKKALGERWMYLGDESTVIQRDIMSAILIYFADLKNQTHNPEVVKASLEGLKRGLTDAGYVKHLKLPRSSGSKDPLFAPEPKALTTEELRSKCFRVASNSHSSTLNGTDGKAVGWSETFWL

SEQ ID NO: 3404 - protein, 530 aa, Unknown
  Description of Unknown: uncultivated organism sequence
  Category: MG91 effectors
  Description: MG91-596 effector
MKTGSVIVSYELTLPQRIYPHLDRLFSVFGRSVRDFIDRFWNESTLELLSQKGHVCSIIKEIVQKPQNLPSRVFRNALELSGQILRSQIERKKLFDTFMQYPCLVLYDEKEIAKSLNTSIWFALNVKRQVLKLLRKGERGDYFSLVKPSFSNSVVITSADDSLERGQFKKLRIEKNKLLFELKVPIGNTWKWVKVTKFIPDRLRKALRNAKEIKAPLIKRVTLKSGFTIYRLVIPVEVELRVKNRVERVFALDLSPSEKRLGVGVVVDKEGHSKPVLFTAYKMVRKLERLYGEISGLERKIDNIADDLHSTFKKGHKERLNQRLRHLYQEQKLRWRKFKELRKQILETFINLVIAHAKAYSCDAIAIEDLKFKDLPDWENKRFRRLFSTWFYSRLEERLRHKAQREGIKVLSVNPFNTSQVCHECGSKGKANRFEFVCESCGKRFDRDYNASVNIGIKALTLACKTKSKPYMGEDIPARVSSLQVLTRYKFKALLTLLSFLKLLAYLRLVETSYLKLKSLLKCISADKYG

SEQ ID NO: 3405 - protein, 529 aa, Unknown
  Description of Unknown: uncultivated organism sequence
  Category: MG91 effectors
  Description: MG91-597 effector
MNTPSFVIELPIRTDDHERRTIVGKLEYARCLHNATLGTALGQLQQMRQDPAWKKACRMPKGKERTNAFRALDRQYGLTEYDLHAVIARHRQGSGRKEELGINETQKIATRIFQAVSRYKLGLGGRPRFKSQSRGLHSIEGKTNKTGLKFKPETSTLDWCGHEYRVLIDQRDGYLQRALREEADPKRWRKVKYCRLVRKRIRGKERFYLQVVLEGTAPLKRVYAPVVERLAIDPCPQTVAVFCPRFAGKIEVAPHAKVDEAELRVLQRSMDRSLRSCNPKAYNEDGTIKPGVELVKSKGYLKRVARLQELYRKAAAARKCDHGQLINLLLCLAGEIRIEKNSWAAFQRSHFGKSLGRSGVADCLSQLKAKAESAGLKVIEAAPYKLKLSQYDPYTDSFQKKQLNERWHRAGTGDEYIQRDVLSAALLYCADLETQSHIPKAALALLEGAKQLLKDAGYWVSKPTSSQDPCDPRFAPEPKALTPETVRLEIFGGTGDSHLQPSCPNGSKGAEGKVSACSKETFALERGVV

SEQ ID NO: 3406 - protein, 1359 aa, Unknown
  Description of Unknown: uncultivated organism sequence
  Category: MG91 effectors
  Description: MG91-598 effector
MQEKPYYLGLDMGTNSVGWAVTDQHYNLLKAKGKDLWGIREFIEADTSVERRTHRISRRRRQREQARIGLLNDYFHDAIIAIDPSFFQRLENSKYHLEDKDQNVRYKYNIFNDPDYTDADYYTQYPTIYHLRKELLENPKPHDVRLVYLALLNMFKHRGHFLNSGISDGNNERSLKDAYINFAISVSELTEDYFNQDVDYSTIEGILSSRDLNRTKKAEELSTVLGIDFKNKKYKEYLRAICGLKINAYTLFSDQLPDDTTKIDLCVSDASFDEKSEELVSLIGEDLFQIILNIKEIYDIGSLAGILKGYTYLSQARVAAYDKHKHDLKLLKSSIKKYCTKEEYNNFFNSDADGSYASYIGSFNSGNKERRVGSKRTSEDLYKEIKKLLKGANKSDPAINEFFTSIETESFLPKQLTASNGIIPNQVHSKEMARILTNAENYLPFLKETDENNLSISNRILQLYKFQIPYYIGPVTEKSQRDGGNGWVIRKDNGRVFPWNIEEKIDVKATSEAFISRMVRRCTYMNGNQVLPKASLEYESFRVLNEINNLRIDGERIPVTLKQDIYTDLFQKGKKVTKKQLCNYLATRGLIESSEQVTGIDIAINNSLSTYGKFKAILGEDIKLDHIQHMIEDIVFWCTVYGDSKQFLKEQIEDKYKGKLSPEQMKRILGFKFKDWGNLSKEFFELKGTDKSTGEAVSIIRALWENNLNLMELINSPEFDFKERLADYEANSLKTLSDFEPEDLNEYYFSAPVRRMIWQTTLIIKELVHVLGEEPARIFIEMTREKDASRGRTLSRKKKFEHLYKNVKDENTDWAKVIEHADESGTIRSKKMYLYLTQKGRCMYTGNHIELSDLFNDNLYDIDHIYPRHFVKDDNIDNNLVLVTKEKNAHKSDNYPLEAEIFNKQRNMWTQLRKEGFISEEKYNRLMGRNAFTDEQKAGFIARQLVETSQGTKGVAELFHQLLPNSKLVYAKAGNVSDFRNNRELPKSRLVNDFHHAHDAYLNIVVGNVYYVKFTQNPMNYIKNSYNKDMNKNNYNLSRMFDWDVKRGDEVAWVAQKQDGAAGTISTVKKMLSKNTPLMTRLSYEGKGALANETLYSAEKAKGEGYIPFKSSDAKIQDVTKYGGFTSVTGAYFFLVEHDQKKKRIRTIESVPLYLADKIDKDSSELERYCDKLGLVNYDIRVRKIKIGSLLNRNGYFAYLTGKTGKQLILRNATNLCLDKKWTRYIKKIEKYKETNVLDSIITSETMVNLYNELLNKFTVGIYGRRPNPIGEKMDSAKNTFTSYTLDNQCNLIYQILQLSKILGFETDLSLLRTNKQSGKPTREGGMQISKKIDNTTSMYLINQSPTGLFETKIDLQTI

SEQ ID NO: 3407 - protein, 524 aa, Unknown
  Description of Unknown: uncultivated organism sequence
  Category: MG91 effectors
  Description: MG91-599 effector
MNEVFVLELPLQVEKYQADILNKRYEQLRQLYNYVQGKLLRQYRYFEQMKEYQICKTFREKRDFFKSHPFQINEKLKGNKTPFKVSFDEYSLKGYIEKLVQKQVAPNMTYADFGFTTNILDHLGASIWAAWDKMLYDFKAKRISFKKYGELDSFSSRRKVVRGVVYFSGMELHLDTMELAIKMNAKVGKEAKFITLKMLHNPKHADYEMWALKGGVDSVKVVKVVRRLVRSQYKYHVQLTIEGEKPQKGRTLGKGNVGIDLGPTTVAVSGENVVSIDKLVSKCDNIQEEITRLSRKIDRSRRANNPQNFNEDGTIKRGIKLIWNDSKRYKELRRELAELRRKQAAIRKQQHIDRANALLKEGDRFIVENNQISGWTTRAKETKVNENTGKIQKKKRFGKSVANHAPSMFVSILENKVKSLGGEVVKVDTKNAASQYDFTDGSFTKHELRERHVTLSNGDTHQRDMLAAFNLQHLKYDEKDTKQYDTEAMAADYERFCQLEQEEILRYKNKEKKDDRGTIGAEKL

SEQ ID NO: 3408 - protein, 490 aa, Unknown
  Description of Unknown: uncultivated organism sequence
  Category: MG91 effectors
  Description: MG91-600 effector
MARENENSGCFVVTFPLKTEKWQEDRIDKILTLLTVRYREKQKILLDRYIHLSHSPEFKEAKKTGLKAFRDFMNEHNFTKYDVEKVFSDSSLSKSVTADIMLTHGINSSIMQELSHRAWSAWEKKLYGQGKFIKLDNEVNIFKSRLKGSTITGFEYSFTDMTLSMNATKPKKHTMFTIPFVVNRKSEYEAYALGCEVRNIAIMRQQIRGKNKYYVQFSFAGTPYNKGRKMGTGIVGIDPGPSKIAIVSDSEIRITTLAPSVNRDERAICRMQRKLDRSRRATNPDNYNDDGTIKRGIKLTFEKSNSYKRTQAKLADTQRKLAAKRKIDHNILANEIIAMGNEFHVENNSFKSMQARSKETKKNDKGKNMSKKRFGKSLANRAPSELLTILKNKVNQYADGDYVDIPSGVACTQFDFTNGEFTKHELKERTITTSDGVVHDRDALAAFNMRFVHKKKIEGKKKIEKDKENFDILAMTDAYRQFCSLEKNIK

SEQ ID NO: 3409 - protein, 504 aa, Unknown
  Description of Unknown: uncultivated organism sequence
  Category: MG91 effectors
  Description: MG91-601 effector
MFDAPSGADHLIKMRATAEWQTARAMPKSSERTKAFRDLRVRFRLSEYDFHADVAMHRKASGRGHLLGINECQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGHIIVEDNSYKAFQRGRFGKTIGRHAPAALYAQLASKAESAGLLVEVVSPKKLKPSQHNLLTDTFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3410 - protein, 529 aa, Unknown
  Description of Unknown: uncultivated organism sequence
  Category: MG91 effectors
  Description: MG91-602 effector
MNTPSFVIELPIRTDDHERRTIVGKLEYARCLHNATLGTALGQLQQMRQDPAWKKACRMPKGKERTNAFRTLDRQYGLTEYDLHAVIARHRQGSGRKEELGINETQKIATRIFQAVSRYKLGLGGRPRFKSQSRGLHSIEGKTNKTGLKFKPETSTLDWCGHEYRVLIDQRDGYLQRALREEADPKRWRKVKYCRLVRKRIRGKERFYLQVVLEGTAPLKRVYAPVVERLAIDPCPQTVAVFCPRFAGKIEVAPHAKVNEAELRVLQRSMDRSLRSCNPKAYNEDGTIKPGVELVKSKGYLKRVARLQELYRKAAATRKCDHGQLINLLLCLAGEIRIEKNSWAAFQRSHFGKSLGRSGVADCLSQLKAKAESAGLKVIEAAPYKLKLSQYDPYTDSFQKKQLNERWHRAGTGDEYIPRDVLSAALLYCADLETQSHIPKAALALLEGAKQLLKDAGYWITKPTSSQDSRDPRFAPEPKALTPETVRLEIFGGTGDSPLQPSCPNGSKGAEGKVSACSKETFPLQRGVV

SEQ ID NO: 3411 - protein, 525 aa, Unknown
  Description of Unknown: uncultivated organism sequence
  Category: MG91 effectors
  Description: MG91-603 effector
MEEVFVLELPLQVEKYQEDILNKRYEQLRQLYNYVQGKLLRQYRYFEQMKEYQTCKTFKEKRDFFRSHPFHINGVYGNNKELLDITFDEYGINGFVGKMGKKLVNADTTYADLGITSTLLDRLSLAIWAAWEKMLYDYHAKRISFKKYGELNIFGSRKKTNGSGKKMFSGMELHLETMTLSIKLNGKVGKNAKFITLPILHNPKHVDYEMMALKGGFDSVKVITVVRRMVRGRYKYYLQMSIEGEKPKKGRTLGKGNVGIDLGPTTIAVSSENIASIDKLASKCDNIEVEKKRLGRKIDRSRRANNPGNFNEDGTIKRGVRLTWNDSKRYKALRREMAELQRRQAAIRKQQHINRANALLKEGNTFIVENNQISGWTRKAKETKVNEKTGRIQKKKRFGKSVANHAPAMFVTILENKVKSLGGEVVKVDTQNAASQYDFTNNSFEKHELKERSVTLSNGDIHQRDMLAAFNLQHLKYDESEKKQYDREAMAQHYERFCELEQEEIMRYKSKEKKDDRSTIGAEKL

SEQ ID NO: 3412 - protein, 484 aa, Unknown
  Description of Unknown: uncultivated organism sequence
  Category: MG91 effectors
  Description: MG91-604 effector
MAHKENQKAFVVTFPLRTEKWQEDRIDKMMRMLTTFYNDRQRKLVRRYIYLSHSKAYKEAKGKGVVAFKNYMKEHGFSQYGLDAFFKADTKGALYQCGLNSMFLQYLSQCAWSAWDKKLFGKGDFVKTDKVVNIFCSRNMKGRFCGFDYDLRTFTIRIKSICTKEIICSIPFVVNKNSEYELYALSQKICRIGIVRKLIRSKYKYYVQFTFDGVPYNKGRNIGTGIVGIDPGPSKIAIVGDKKVEIAKLAPNIIEDERKTARLKRKLDRSRRATNPHMYKEDGTNIKGQRQICFSKSYNETRKQLADAQRKLAAKRKIAHNELANTLLEYGDTFKVEANSYKSMQARTKATSMTKSGRIRSKKRYGKSIKNRAPSEFLVILKNKLLYYPKGKYYDVPSSYACTQFDFTNESFTEHKISERRIVTSDGIQHNRDTLAAFNIKNAIVNDTSTKKKKVTKSKEFFDIVKMKASYNEFCVMEHYLLSE

SEQ ID NO: 3413 - protein, 530 aa, Unknown
  Description of Unknown: uncultivated organism sequence
  Category: MG91 effectors
  Description: MG91-605 effector
MTSQSFVIELPIAVDDAEMRTIVRKLEFARQLHNATLGTAMGQLQLMRQDAAWKEACVMPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDRLHEMHRVAAAQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKAAVEQLEGAKQLLTDAGYVVLKSTSSRDQRDPRLASEPKAMTPEMARQKILRGAGDSHLPTDQELGRIRAGGKVSTWSKETFPLQRGVV

SEQ ID NO: 3414 - protein, 405 aa, Unknown
  Description of Unknown: uncultivated organism sequence
  Category: MG91 effectors
  Description: MG91-606 effector
MPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGLYIQRDILSALLLYCADIEKEIHIPKVAVEQLEGTKQFLTDAGYVVLKSTSSRDQRDPRLASEPKAMTPEMARQKIFRGAGDSHLPTDQELGQIRAGGKVSTWSKETFPLQRGVV

SEQ ID NO: 3415 - protein, 529 aa, Unknown
  Description of Unknown: uncultivated organism sequence
  Category: MG91 effectors
  Description: MG91-607 effector
MNTPSFVIELPIRTDDHERRTIVGKLEYARCLHNATLGTALGQLQQMRQDPAWKKACRMPKGKERTNAFRALDRQYGLTEYDLHAVIARHRQGSGRKEELGINETQKIATRIFQAVSRYKLGLGGRPRFKSQSRGLHSIEGKTNKTGLKFKPETSTLDWCGHEYRVLIDQRDGYLQRALREEADPKRWRKVKYCRLVRKRIRGKERFYLQVVLEGTAPLKRVYAPVVERLAIDPCPQTVAVFCPRFAGKIEVAPHAKVNEAELRVLQRSMDRSLRSCNPKAYNEDGTIKPGVELVKSKGYLKRVARLQELYRKAAAARKCDHGQLINLLLCLAGEIRIEKNSWAAFQRSHFGKSLGRSGVADCLSQLKAKAESAGLKVIEAAPYKLKLSQYDPYTDSFRKKQLNERWHRAGTGDEYIQRDVLSASLLYCADLETQSHIPKAALALLEGAKQLLKDAGYWVSKPTSSQDPCDPRFAPEPKALTPETVRLEIFGGTGDSPLQPSCPNGSKGAEGKVSACSKETFPLQRGVV

SEQ ID NO: 3416 - protein, 525 aa, Unknown
  Description of Unknown: uncultivated organism sequence
  Category: MG91 effectors
  Description: MG91-608 effector
MEEVFVLELPLQVEKYQEDILNKRYEQLRQLYNYVQGKLLRQYRYFEQMKEYQTCKTFKEKRDFFRSHPFHINGVYGNNKELLDITFDEYGINGFVGKMGKKLVNADTTYADLGITSTLLDRLSLAIWAAWEKMLYDYHAKRISFKKYGELNIFGSRKKTNGSGKKMFSGMELHLETMTLSIKLNGKVGKNAKFITLPILHNPKHVDYEMMALKGGFDSVKVITVVRRMVRGRYKYYLQMSIEGEKPKKGRTLGKGNVGIDLGPTTIAVSSENIASIDKLASKCDNIEVEKKRLGRKIDRSRRANNPGNFNEDGTIKRGVRLTWNDSKRYKALRREMAELQRRQAAIRKQQHINRANALLKEGDTFIVENNQISGWTRKAKETKVNEKTGRIQKKKRFGKSVANHAPAMFVTILENKVKSLGGEVVKVDTQNAASQYDFTNNSFEKHELKERSVTLSNGDIHQRDMLAAFNLQHLKYDEAEKKQYDREAMAQHYERFCELEQEEIMRYKSKEKKDDRSTIGAEKL

SEQ ID NO: 3417 - protein, 544 aa, Unknown
  Description of Unknown: uncultivated organism sequence
  Category: MG91 effectors
  Description: MG91-609 effector
MNLDSRVMNVSPRIVIRQSKVKEVFVLELPLRVEKYQADLLNKRFEQLRQLYNYVQGKLLRQYRYFEQMKEYQACKTFKEKKDFFRKHPFHINGILGSNKKPLNITFDEYGIRGFVEKLVQKGVGASMTYADLGFTTSILDHLSSGIWSAWDKMLYDYKARRISFRKYGELDSFSSRRKVVQGKIYFSGMELHLDSMMLSVKMNGKIGKAAKFITLPILHNPKHANYEMWALRGGLDSVKVVKVVRRLIRGQYKYYFQMTIEGEKPQKGRTLGKGNVGIDLGPTTVAVSSENIVSIDKLASKCDSIEAEKAKLGRKIDRSRRANNPQNFNEDGTIKRGVRLVWNDSKRYKALRGEMAELQRRQSAIRKQQHIDRANELLKEGDIFIVENNQISGWTRKAKETRVDESTGRIRKKKRFGKSVANHAPSMFVNILENKVKSLGGQLVKVDTQNAASQYDFTDGSFTKHELQERNVTLSNGDTHQRDMLAAFNLQHLKYDEAEKKQYDREAMSKHYERFCELEQAEILRYKNKEKVDDRSTIGAKEL

SEQ ID NO: 3418 - protein, 530 aa, Unknown
  Description of Unknown: uncultivated organism sequence
  Category: MG91 effectors
  Description: MG91-610 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINEAQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYTPVTERAAIDPGPQSIALFSKAFAGKIQVAGPNNFNEAASRRLLRAMDRSLKRNNPDAYNEDGTIKKGAKLVKSKNYQRKVDRLREMHRVSAAERRCLHGQTINLLLSIAGDIRIEKNSWKAFQRGHFGKSLGKSAMSGFIAQLKSKAASAGLKVTEVNPYKLKLSQYDPYTDTYRKKDLRERWQEMKAGSGLYIQRDILSALLLYCADIEKEIHIPKVAVEQLEGAKQFLTDAGYVVLKSTSSRDQRDPRLASEPKAMTPEMARQKILRGAGDSHLPTDQALGRIRAGEKVSTWSKETFPLQRGVV

SEQ ID NO: 3419 - protein, 530 aa, Unknown
  Description of Unknown: uncultivated organism sequence
  Category: MG91 effectors
  Description: MG91-611 effector
MTSPSFVIELPIAVDDAEMRTIVRKLEFARQLHNATLGTALGQLQQMRQDTAWKQACAMPKGKERTAAFRALDRKYGLTEYDLHSVIARHREGTSRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQLLTDAGYVVLKSTSSRDQRDLRLAPEPKAMTPEMARQKILRGAGDSHLPTDQELGRIRAGGKVSTWSKETFPLQRGVV

SEQ ID NO: 3420 - protein, 1358 aa, Unknown
  Description of Unknown: uncultivated organism sequence
  Category: MG91 effectors
  Description: MG91-612 effector
MEKEYYLGLDMGTNSVGWAVTDDAYNLIRFKGKDMWGIREFDEANPAVERRTHRTSRRRKQRNAVRMGLIRSYFADEIQKVDSNFYQRLDNSFFHVEDKQDNVKDKNGIFNDKNYKDADYYKQYPTIFHLRKELIEDASQKDVRLVYLAVANMFKHRGHFLLSGIGSESSKQTITDLYNQVSGLITEEYGISLKTDIAGTDFEQVLCSREYSRTRKSEKVCEILEIKNSDKLKKAFVKSMCGLSVKITDIIDDTFTEISDEDKKITFSFVDSDYDEKAGVLEEKLGTDVYDIISKLKEIHDKAQVAEIMKNYQYLSFARVADYEKHKKDLKILKRVVKKYFEPTVYDKLFRSEENGTYSAYVNSFNSEEKSRRNYKERKQEDLYNSIKKLLKSVDNVDDTDIEYIKNEMDKENFLPKQLTFKNGVIPNQIHASELKAILKNAEKYLPFLNEKDESGYTVSERILMLFSFQIPYYVGPVSSNSNGWVKRLEPGQVLPWNIDKKIDLKETSEQFIQRMVRNCTYIAGEKVLPKASLLYENFKVLNEINNLSINGERITVNLKQDLYNTLFLKGKRVTRKQIFNYFHSRGLVEEDSQISGIDIAVNNSLSTYGKFLPLFGEHLKEDKYKKMVDDIVFWCTVYGDSRKFLREQLEEKYSDVLDENQIKRITGMKFKDWGNLSKEFLELSGCCKSTGEVMPLIRAMWETNYNLMELLHSEEFTYSEELEEKQGKIEKVLSEYTIDDLNEEYFSAPVKRMVWQTLLIIKEIEKIMKCPPTRIFVEMTRKDDEKGDNGRKSSRKDQLLALYKKIQSEDKEWKKEMSSRIEDYDKKGALRSKKLYLYFIQKGLDMYTGKPIDLDNLMSANSNYDIDHIYPRHFVKDDNINNNLVLASKPANAEKSDIYPIKDSIYQKMKYTWKVLRDEGLITEEKYKRLTGRNPFTDEQKAGFIARQLVETGQGTKGVADLLTALLPDTKLVYSKAGNVSDFRKKYDIPKSRLINDFHHAHDAYLNIVVGNIYFTKFTSNPLNYIRKECLSKDNKYQYNLGNMYKWDVKRDGKTAWIAAKEGETGTIATVKKMLSRNTPTLTRLTIEGHGGIADATLYSHKKAKQDAYIPLKSSDARMADVTKYGGYSSVTTAYLFLVEHEIKGKKIRTLETVPLYLKDRLENSKEKLEEYCRETLGYTNPSVRMKKIKLQSLIKLNGYYMQISGKTNKQFTVRNYVQFCLNSKWVDYIHKLEKYQDKGVIDDAITDEKNVELYNVLCEKHSVGIFTLRPNPVGDKIKKGYDKFVNLTTEEQIKLLIEIIKLTCVGIVSANLTLIGGASISGKMLISKNITDAKECLLINQSVTGLYENRIDLLRV

SEQ ID NO: 3421 - protein, 537 aa, Unknown
  Description of Unknown: uncultivated organism sequence
  Category: MG91 effectors
  Description: MG91-613 effector
MSTKSFTINLPIITGDQDRRRLQKSFSFGCNLQNAVMGGGWDCVLKMRATPEWQAARAMPKGSERTKAFRDLRVQFRLSEYDFHADVAMHRKASGRGHLLGINECQKLASRAWISVERHLYNGGSPRFISSRRGLHSIEGKTNRTGIIWKADQQCVTVCKRVYRVRVDKRDDWLTRALQDPTDPKKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATCKREHGEVCNWLLGHAGHIIVEDNSYKAFQRGRFGKTIGRHAPAALYAQLTNKAESAGLLVEVVSPKKLKPTQHNLLTGQFVKHELWERRVRLGNDDDDRWIDRDAAACLNLLYADLEKQTYAPERIREAVLAGVTAWLDAGVVVIQAREGITEREFGRFRRRGIPSLAVQGLRQQGFRGRSDSKSGVTPRRKASTVSKPSHFSGEVV

SEQ ID NO: 3422 - protein, 530 aa, Unknown
  Description of Unknown: uncultivated organism sequence
  Category: MG91 effectors
  Description: MG91-614 effector
MTSPSFVIELPIAVDDAEMRTIVRKLEFARQLHNATLGTALGQLQQMRQDTAWKQACAMPKGKERTAAFRALDRKYGLTEYDLHSVIARHREGTSRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKVAVEQLEGAKQFLTDAGYVVLKSTSSRDQRDPRLASEPKAMTPEMARQKILRGAGDSHLPTDQALGRIRAGGKVSTWSKETFPLQRGVV

SEQ ID NO: 3423 - protein, 506 aa, Unknown
  Description of Unknown: uncultivated organism sequence
  Category: MG91 effectors
  Description: MG91-615 effector
MVVEVKFSPMTSPTFIIELPIRVSDSESRTILRKLEFARQLHNATLGTALGQLQQLRQDSEWEKACLMPKGKERSELFRKLDRKYQLTEYDLHTVIAKHRPRSGRKTELGINETQKIATRVFQAVNRYKLGLGGRPRFKSLSRGLRSIEGKSNKTGLKFNIEKSVLSWCKHDYRVFIDPQDDFLQRALRSEGRSGFKKVKYCRLVRKTIKGKNRFYLQVVLEGQAPIKHIYASTSERLSIDPGPQTIAVFSDVWAGKIKVSPTAQVDEKRLRCIQRSMDRSLRKSNPDCYESDGTLRKGCVLKKTKGYEKRIQRLQECHRKAAATRRCEHGQLINLLLSMAGDIRVEKNQWKAFQRGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGVKQLLRDAGYVILKPSSNGESNPTFASEPKAVTPEKVRLEIFCGASDSYL

SEQ ID NO: 3424 - protein, 524 aa, Unknown
  Description of Unknown: uncultivated organism sequence
  Category: MG91 effectors
  Description: MG91-616 effector
MNEVFVLELPLLVERYQADILNKRYEQLRQLYNYVQGKLLRQYRYFEQMKEYKACEKIKEKRDFFRAHPFHINGVLNGNKEQLDITFDKNGINGFVEKLAQKSAGPNITYADLGFTTYILDHLSASIWAAWEKKLYDFKAKRISFKKYGELDSFSSRRKVVGGKVYFSGMELHLDTMKLSIKMNGKQGDNAKFITLKMLHNTKHADYEMWALKGGVDSVKVVKVVRRLVRSQYKYYVQLTIEGEKPQKGRKLGKGNVGIDLGPTTVAVSGENVVSIDKLASKCDNIQEEITRLSRKIDRSRRANNPQNFNEDGTIKRGIKLIWNDSKRYKELRRELAELRRKQAAIRKQQHIERANALLKEGDTFIVENNQISGWTTRAKETKVNEKTGKIQKKKRFGKSVANHAPSMFVSILENKVKSLGGEVVKVDTKNAASQYDFTDNCFTKHELKERNVTLSNGDTHQRDMLAAFNLQHLKYDEAEAKQYDTEAMAANYERFCQLEQEEIQRYKNKEKKDDRSTIGAEKL

SEQ ID NO: 3425 - protein, 530 aa, Unknown
  Description of Unknown: uncultivated organism sequence
  Category: MG91 effectors
  Description: MG91-617 effector
MRTSSIIVSYELTLPQRIYPHLDRLFSVFGRSVRDFIDRFWNESTLELLSQKGHVCSILKEIVQKPQNLPSRVFRNALELSGQILRSQIERKKLFDTFMQYPCLVLYDEKEIAKSLNTSIWFALNVKRQVLKLLRKGERGDYFSLVKPSFSNSVVITSADDSLERGQFKKLRIEKNKLLFELKVPIGNTWKWVKVTKFIPDRLRKALRNAKEIKAPLIKRVTLKSDFTIYRLVIPVEVELRVKNRVERVFALDLSPSEKRLGVGVVVDKEGHSKPVLFTAYKMVRKLERLYGEISGLERKIDNIADDLHSTFKKGHKERLNQRLRHLYQEQKLRWRKFKELRKQILETFINLVIAHAKAYSCDAIAIEDLKFKDLPDWENKRFRRLFSTWFYSRLEERLRHKAQREGIKVLSVNPFNTSQVCHECGSKGKANRFEFVCESCGKRFDRDYNASVNIGIKALTLACKTKSKPYMGEDIPARVSSLQVLTRYKFKALLTLLSFLKLLAYLRLVETSYLKLKSLLKCISADKYG

SEQ ID NO: 3426 - protein, 525 aa, Unknown
  Description of Unknown: uncultivated organism sequence
  Category: MG91 effectors
  Description: MG91-618 effector
MEEVFVLELPLQVEKYQEDILNKRYEQLRQLYNYVQGKLLRQYRYFEQMKEYQTCKTFKEKRDFFRSHPFHINGVYGNNKELLDITFDEYGINGFVGKMGKKLVNADTTYADLGITSTLLDRLSLAIWAAWEKMLYDYHAKRISFKKYGELNIFGSRKKTNGSGKKMFSGMELHLETMTLSIKLNGKVGKNAKFITLPILHNPKHVDYEMMALKGGFDSVKVITVVRRMVRGRYKYYLQMSIEGEKPKKGRTLGKGNVGIDLGPTTIAVSSENIASIDKLASKCDNIEVEKKRLGRKIDRSRRANNPGNFNEDGTIKRGVRLTWNDSKRYKALRREMAELQRRQAAIRKQQHINRANALLKEGNTFIVENNQISGWTRKAKETKVNEKTGRIQKKKRFGKSVANHAPAMFVTILENKVKSLGGEVVKVDTQNAASQYDFTNNSFEKHELKERSVTLSNGDIHQRDMLAAFNLQHLKYDEAEKKQYDREAMAQHYERFCELEQEEIMRYKSKEKKDDRSTIGAEKL

SEQ ID NO: 3427 - protein, 529 aa, Unknown
  Description of Unknown: uncultivated organism sequence
  Category: MG91 effectors
  Description: MG91-619 effector
MKEVFVLELPLQVEKYQADILNKRYEQLRQLYNYVQGKLLRQYRYFEQMKDYQACKAFKEKREFFKTHPFHINGVLGRNKELLDITFNEYGILGWVTKLGQMSIGSGKTYADIGITARILANLSDNIWSAWNKKLYDYRSERISFKKYGSLNTFGSGKTILKKGKEIKEYFSGMVLHLERMEIDIKTNGSNGKNATFISLPILHNPKHADYEMMALSGGSSSIKVLTIVRRLVRGQYKYYLQLSIEGEKPQKGRTLGKGNVGIDLGPTTIAVSGENVVSIDKLASKCDNIQTEITKLARKIDRSRRANNPQNFNEDGTIKRGIKLVWNDSKRYKELRRELAELCRKQAAIRKQQHIDRANALLKEGDTFIVENNPVKAWAARAKETKVNEKTGKIQSKKRGGKSIGNHAPAMFVDILENKVKSLGGTFIRANTNNAASQYDFSNNSFKEGEDRHGLNERAITLSNGNTHQRDMLAAFNLQHLTDEKKQYDVEAMKRDYERFCQLEQEEIQRYKNKEKKDDRSTIGAEKL

SEQ ID NO: 3428 - protein, 537 aa, Unknown
  Description of Unknown: uncultivated organism sequence
  Category: MG91 effectors
  Description: MG91-620 effector
MSTKSFIISLPIITGDQDRRRLRKSFSFGCNLQNAVMGGGWDRVLKMRATAEWQTARAMPKNSERTKAFRDLRVRFRLSEYDFHADVAMHRKASGRGHLLGINECQKLASRAWISVERHLYNGGSPRFISSRRGLHSIEGKTNRTGIIWKADQQCVTVCKRVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKKKSFKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGTTPRRKASTVSKPSHFSGEVV

SEQ ID NO: 3429 - protein, 525 aa, Unknown
  Description of Unknown: uncultivated organism sequence
  Category: MG91 effectors
  Description: MG91-621 effector
MEEVFVLELPLQVEKYQEDILNKRYEQLRQLYNYVQGKLLRQYRYFEQMKEYQTCKTFKEKRDFFRSHPFHINGVYGNNKELLDITFDEYGINGFVGKMGKKLVTADTTYADLGVTSTLLDRLSLAIWAAWEKMLYDYHAKRISFKKYGELNIFGSRKKTNGSGKKMFSGMELHLETMTLSIKLNGKVGKNAKFITLPILHNPKHVDYEMMALKGGFDSVKVITVVRRMVRGRYKYYLQMSIEGEKPKKGRTLGKGNVGIDLGPTTIAVSSENIASIDKLASKCDNIEVEKKRLGRKIDRSRRANNPGNFNEDGTIKRGVRLTWNDSKRYKALRREMTELQRRQAAIRKQQHINRANALLKEGDTFIVENNQISGWTRKAKETKVNEKTGRIQKKKRFGKSVANHAPAMFVTILENKVKSLGGEVVKVDTQNAASQYDFTNNSFEKHELKERSVTLSNGDIHQRDMLAAFNLQHLKYDESEKKQYDREAMAQHYERFCELEQEEIMRYKSKEKKDDRSTIGAEKL

SEQ ID NO: 3430 - protein, 524 aa, Unknown
  Description of Unknown: uncultivated organism sequence
  Category: MG91 effectors
  Description: MG91-622 effector
MYEVFVLELPLQVEKYQADILNKRYEQLRQLYNYVQGKLLRQYRYFEQMKEYQACKTIKEKRDFFKSHPFQVNESLCGDKSAFEISFNEFSIKGFIEKLVQKSVGANMTYADLGFTTNILDHLGASVWAAWDKKLYDFKAKRISFKKYGELDSFSSRRKVVGGKVYFSGMELHLDTMELAIKMNGKQGNNAKFITLKMQHNPKHAEYEMWALKGGVDSVKVVKVVRRLVRSQYKYYVQLTIEGEKPQKGRTLGMGNVGIDLGPTTVAVSGENVVSIDKLASKCDNIQEEITRLSRKIDRSRRANNPQNFNEDGTIKRGVKLIWNDSKRYKELRRELAELRRKQAAIRKQQHIDRANAILKEGDTFIVENNQISSWTTRAKETKVNEKTGKIQKKKRFGKSVANHAPSMFVSILENKVKSLGGEVVKVDTKNAASQYDFTDGSFTKHELKERNVTLSNGDTHQRDMLAAFNLQHLKYNEAEAKQYDTEAMAADYERFCQLEQEEIQRYKNKEKKDDKGTIGAEKL

SEQ ID NO: 3431 - protein, 530 aa, Unknown
  Description of Unknown: uncultivated organism sequence
  Category: MG91 effectors
  Description: MG91-623 effector
MPSQSFVIELPIAVDDAEMRTIVRKLEFARQLHNATLGTAMGQLQQMRQDAAWKEACVMPKGKERAAAFRALDHKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAASRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGQIRAGGKVSTWSKETFPLQRGVV

SEQ ID NO: 3432 - protein, 525 aa, Unknown
  Description of Unknown: uncultivated organism sequence
  Category: MG91 effectors
  Description: MG91-624 effector
MEEVFVLELPLQVEKYQEDILNKRYEQLRQLYNYVQGKLLRQYRYFEQMKEYQTCKTFKEKRDFFRSHPFHINGVYGNNKELLDITFDEYGINGFVGKMGKKLVNADTTYADLGITSTLLDRLSLAIWAAWEKMLYDYHAKRISFKKYGELNIFGSRKKTNGSGKKMFSGMELHLETMTLSIKLNGKVGKNAKFITLPILHNPKHVDYEMMALKGGFDSVKVITVVRRMVRGRYKYYLQMSIEGEKPKKGRTLGKGNVGIDLGPTTIAVSSENIASIDKLVSKCDNIEVEKKRLGRKIDRSRRANNPENFNEDGTIKRGVRLTWNDSKRYKALRREMAELQRRQAAIRKQQHINRANALLKEGDTFIVENNQISGWTRKAKETKVNEKTGKIQKKKRFGKSVANHAPAMFVTILENKVKSLGGEVVKVDTQNAASQYDFTNNNFKKHELNERSVTLSNGDTHQRDMLAAFNLQHLKYDEAEKKQYDREAMSKHYERFCELEQAEIVRYKNKEKADDRSTIGAKEL

SEQ ID NO: 3433 - protein, 491 aa, Unknown
  Description of Unknown: uncultivated organism sequence
  Category: MG91 effectors
  Description: MG91-625 effector
MRATAEWQTARAMPKSSERTKAFRDLRVHFRLSEYDFHADVAKHRKASGRGHLLGINECQKLASRAWISVERHLYNGGSPRFISSRRGLHSIEGKTNRTGIIWKADQQCVTVCKRVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRQATNPDNYETVEVVRHGKKHKSLKVKSGRLQWRFSKRSENLRAELAEIFRLSAATRKREHGEICNWLLDHAGHIIVEDNSYKAFQKGHFGKSIRRHAPAAFYTQLTSKAESAGLQVTVVSPRKLKPSQHNLLTDTFVKHELWERRVRLGNDDDDRWIDRDAAACLNLLYADIDKQTYDPKRIREAVLAGVTAWLDAGVVVIQAREGITEREFGRFRRRGIPSLTVQGLRQQGFRGRSDSKSGTTPRRKASTVSKPSHFSGEVV

SEQ ID NO: 3434 - protein, 531 aa, Unknown
  Description of Unknown: uncultivated organism sequence
  Category: MG91 effectors
  Description: MG91-626 effector
MNEVFVLELPLQVEKYQADILNKRYEQLRQLYNYVQGKLLRQYRYFEQMKEFQDCKTFKAKREFIKAHPFQIKGVMGRNKELLDIFFDEYGILGLITKLGQKPIGSGKTYTDMGISSTILANLSNSIWSSWNKKLYDYHADRISFKKYGGLNTFGSGKIIQKKDNEVKEYFPGMVLHLDRMEIDIKTNGGLGKKATFITLPILHNPKHADYEMNALSGGSSSIKVLTIVRRMIRGQYKYYLQMSIEGEKPQKGRLLGKGNVGIDLGPTTVAVSGENIVSIDKLASKCDDIQEVITRLSRKIDRSRRANNPQNFNEDGTIKRGIKLVWNDSKRYKELRRELAELRRKQAAIRKQQHIDRANALLKEGDTFIVENNQISSWTTRAKETKVNEKTGKIQKKKRFGKSIANHAPSMFINILENKVKSLGGKVVKGDTKNAASQYDFTDGSFTKHELKERNVTLSNGDTHQRDMLAAFNLQHLKYNEAEAKQYDTEAMAADYERFCQLEQEEILRYKNKEKKDDRSTIGAEELLKT

SEQ ID NO: 3435 - protein, 410 aa, Unknown
  Description of Unknown: uncultivated organism sequence
  Category: MG91 effectors
  Description: MG91-627 effector
MRATAEWQTARAMPKNSERTKAFRDLRVRFRLSEYDFHADVAMHRKASGRGHLLGINECQKLASRAWISVERHLYNGDAPRFISSRRGLHSIEGKSNRTGIIWKADQQCVTVCKRVYRVRVDKRDDWLTRALQDPTDPKKPRKVKYCRIVREMRKGKERFFLQLVAEGTSPLKHAYAGKDLHMAIDPGLGSLTYATEDGTIAKVQIAPSADTDRRAIRRIQRAMERSRRTTNPDNYEAVDVVRHGKKKKSFKVKSGRLQWRFSKRYEKLRSELAEMLRLCTATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADIENQIRPGTDP

SEQ ID NO: 3436 - protein, 1347 aa, Unknown
  Description of Unknown: uncultivated organism sequence
  Category: MG91 effectors
  Description: MG91-628 effector
MEEKEYYLGLDMGTNSVGWAVTDPQYTILRAKGKDMWGIREFESAETAEKRRGHRTSRRRRQREVVRMGLVKDYFSDAINNVDGNFYARLENSKYHLEDKDEAVRNKNGIFADEHYTDKEYYAEYPTIYHLIMELINNPAPHDVRLVYLAVANLFKRRGHFLNAGLSEDGGNQSMQTAYDGFNTTCNETLGFSFPGINATQIEEVLKNRNYSKTVKSEKLAELLGVEKKEKQRIEILRAIAGRKVNAKVIFPNVETEDKVEFSFSDAAFDDNATELMTLLGDECYSLVLCMREMYDIGTLAEIMHGCQYLSESRMADYQKHHEDLVLLKSVIKSECTQKQYDELFRLDGEGSYSAYVNSTLAKNHKQRRSMKGRTRDDFYKKVRGLIGKSSNPDAIKICTEIENETFMPKMLTSANGIIPNQVHYKELKAILSNAEKYLSFLLEKDESGLTTSDRIQRLYKFRIPYYVGPVSNRDGKGNGWAVRKEEGTVLPWNLEEKIDLSKTKEAFIENLIRRCTYISDEKVLPKNSLIYEKFTVLNEINNIRINDERISVDLKQDIYNELFKKGKKVTRKTLAKYLINRGVIEAENQISGIDIAINNSLSSYGKFKAVFGESMDTDTTKKMVEDIIKTSTIYGDDKRELKNILRDKYGEILSEDQIKRIAGFRFKDWGRLSRAFLELAGADCRTGEVTSIIQALWESQLNLMELLHSEDYTFGESLNEKLVKNEKSLSEITAEDLDDYYFSAPVKRMAWQTILLIKEISKIKGCEPSKIFIEMTRTDEEKGDKGRKNSRAKELTALYKNIKKEGKAWIELIGKEDASGRLKSKKMYLYIKQMGRDMYTGEQIDLDRLFDDNLYDIDHIYPRHFVKDNNIENNLVLVNKAKNSRKSDNYPLDSDIVRNPKVRELWEMLHTNHLMSDEKYHRLTSRKAFTDEDMAGFIARQLVETGQATKGVADLLKDLTNSEIIYSKAGNVSDFRHAYDIPKSRIVNEFHHAHDAYLNIVVGNAYYTKFTSNPLNYIRNEYKKNTKENNYHLNKIFESTISRNGYVAWLAGSDKNPGTIQTVKKMLSRNTPLMTRMTFVIHGSIAKETLCGKNIAKEDSYLPLKGSDPRMSVEKYGGFNKASGAYFFLVEHELKGKKVRTIETVPVYLMKKLSDERELQKYCEEKLGLINPSIRLKQIKMQSLIKLNGYFVNVTGRTNKQLTLRNAVNLKLDKEDIYIIHLVEKCIGEERDDRLSEESILSLYQTLTEKQASGIYRNRPNSVYEKLNEGMIRFKNLERKQQIKVLANILNLTMVGKAQADLKDIGGSANSGVMLMAKKINNYNEVKLINQSVTGLYQTEVDLLTV

SEQ ID NO: 3437 - protein, 525 aa, Unknown
  Description of Unknown: uncultivated organism sequence
  Category: MG91 effectors
  Description: MG91-629 effector
MEEVFVLELPLQVEKYQEDILNKRYEQLRQLYNYVQGKLLRQYRYFEQMKEYQTCKTFKEKRDFFRSHPFHINGVYGNNKELLDITFDEYGINGFVGKMGKKLVNAGTTYADLGITSTLLDRLSLAIWAAWEKMLYDYHAKRISFKKYGELNIFGSRKKTNGSGKKMFSGMELHLETMTLSIKLNGKVGKNAKFITLPILHNPKHVDYEMMALKGGFDSVKVITVVRRMVRGRYKYYLQMSIEGEKPKKGRTLGKGNVGIDLGPTTIAVSSENIASIDKLASKCDNIEVEKKRLGRKIDRSRRANNPGNFNEDGTIKRGVRLTWNDSKRYKALRREMAELQRRQAAIRKQQHINRANALLKEGDTFIVENNQISGWTRKAKETKVNEKTGRIQKKKRFGKSVANHAPAMFVTILENKVKSLGGEVVKVDTQNAASQYDFTNNSFEKHELKERSVTLSNGDIHQRDMLAAFNLQHLKFDESEKKQYDREAMAQHYERFCELEQEEIMRYKSKEKKDDRSTIGAEKL

SEQ ID NO: 3438 - protein, 522 aa, Unknown
  Description of Unknown: uncultivated organism sequence
  Category: MG91 effectors
  Description: MG91-630 effector
MDKEVFVIEFPLNVEKWQADILNKRYEHLRTLYNYVQGKLLRQYIYFAKMGEYKNCKTPKERREFFKTHAFHIKGISGRNKFSLDITFTEYGIHSLVTKLAQHRIGADCTYGDKGINSMILDHMAAYIWSSWNKKLYDINARRISFKNFGEINTFGVRKINGARFCGLNLHLDIMTLDIKVNGKNGQQAKFISLPIRYNLKHADYEMNALAGGFDSIKVLTVVRRMVRGRYKYYLQMTIEAVKPQKGRHLGNGRVGIDIGPTTIAVSSNSTVSIDKLAAKCDNIEQDIQRIGRKIDRSRRAMNPDNFNADGTVKRGVRLTWVKSERYKALCQEKAELQRKQAAIRKAQHIERANTLISEGDTFIIESNPIKGWTARAKETKVSEKTGRIQKKKRWGKSVANHAPSMFVTILENKVKSLGGTVIKADVKNAASQYDFTDGTFNKHELDERGVTLSNGDTHQRDMLSAFNLQHLIYDAKELKQYDQQQMEIHYPRFCELEQQEIEKYKQRIKTDDRSTIAASRL

SEQ ID NO: 3439 - protein, 530 aa, Unknown
  Description of Unknown: uncultivated organism sequence
  Category: MG91 effectors
  Description: MG91-631 effector
MRTSSIIVSYELTLPQRIYPHLDRLFSVFGRSVRDFIDRFWNESTLELLSQKGHVCSIIKEIVQKPQNLPSRVFRNALELSGQILRSQIERKKLFDTFMQYPCLVLYDEKEIAKSLNTSIWFALNVKRQVLKLLRKGERGDYFSLVKPSFSNSVVITSADDSLERGQFKKLRIEKNKLLFELKVPIGNTWKWVKVTKFIPDRLRKALRNAKEIKAPLIKRVTLKSGFTIYRLVIPVEVELRVKNRVERVFALDLSPSEKRLGVGVVVDKEGHSKPVLFTAYKMVRKLERLYGEISGLERKIDNIADDLHSTFKKGHKERLNQRLRHLYQEQKLRWRKFKELRKQILETFINLVIAHAKAYSCDAIAIEDLKFKDLPDWENKRFRRLFSTWFYSRLEERLRHKAQREGIKVLSVNPFNTSQVCHECGSKGKANRFEFVCESCGKRFDRDYNASVNIGIKALTLACKTKSKPYMGEDIPARVSSLQVLTRYKFKALLTLLSFLKLLAYLRLVETSYLKLKSLLKCISADKYG

SEQ ID NO: 3440 - protein, 525 aa, Unknown
  Description of Unknown: uncultivated organism sequence
  Category: MG91 effectors
  Description: MG91-632 effector
MNEVFVLELPLQVEKYQADVLNKRYEQLRQLYNYVQGKLLRQYRYFEQMKEYQACKTIKEKRDFFRSHPFQINETLKGNKIPFMVSFDEYSIKGFVEKLAQKPVGANMTFADLGFTTYILDHLGASIWAAWDKMLYDFKAKRISFKKYGELDSFSSRRKLVGGKVYFSGMEVHLDTMELAIKINGKQSNNAKFITLKILHNPKHADYELWALKGGVNSVKVVKVVRRLVRSQYKYYVQLTIEGEKPQKGRRLGKGNVGIDLGPTTVAVSGVNVVSIDKLASKCDDIQEEITRLSRRIDRSRRANNPQNFNEDGTIKRGIKLVWNDSNRYKELRRELAELRRKQAAIRKQQHIERANALLKEGDTFIVENNPISSWTTRAKETKVNEKTGKIQKKKRFGKSVANHAPSMFVSILENKVKSLGGDLVKVDTKNAASQYDFTNNSFTKHELKERNVTLSNGDTHQRDMLAAFNLQHLQYDEKDDKQYDTEAMTADYERFCQLEQEEILRYKNKVKKDDRGTIGAEKLY

SEQ ID NO: 3441 - protein, 530 aa, Unknown
  Description of Unknown: uncultivated organism sequence
  Category: MG91 effectors
  Description: MG91-633 effector
MTSQSFVIELPIAVDDAEMRTIVRKLEFARQLHNATLGTAMGQLQQMRQDAAWKEACVMPKGKERAAAFRALDRKYGLTEYDLHSVIAGHREGSGRKAELGINETQKIATRVFQAINRFKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNENGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGLYIQRDVLSALLLYCADIEKEIHIPKVAVEQLEGAKQFLTDAGYVVLKSTSSRDQRDPRLASEPKAMTPEMARQKILRGAGDSHLPTDQELGRIRAGGKVSTWSKETFPLQRGVV

SEQ ID NO: 3442 - protein, 385 aa, Unknown
  Description of Unknown: uncultivated organism sequence
  Category: MG91 effectors
  Description: MG91-634 effector
MAHKENQKAFVVTFPLRTEKWQEDRIDKMMRMLTTFYNDRQRKLVRRYIYLSHSKAYKEAKGKGVVAFKNYMKENGFSQYGLNAFFKADTKGALYQCGLNSMFLQYLSQCAWSAWDKKLFGKGDFVKTDKVVNIFCSRNKKERFCGFDYDLSTFTISIKSTYAKKIICTIPFVVNKKSDYELFALSQRICRIGIVRKLIRGKYKYYVQFTFDGVPYNKVRNIGTGIVGIDPGPSKIAIVGDNKVEIAKLAPNIEEDERKTARLKRKLDRSRRATNPHMYKEDGTTIKGQRQTCFSKVYNETRKQLADAQRKLAAKRKIAHNELANTLLEYGDTFKVEANSYKSMQARAKATSMTKSGRIRSKKRYGKSIKNRAPSEFLVILNNSL

SEQ ID NO: 3443 - protein, 537 aa, Unknown
  Description of Unknown: uncultivated organism sequence
  Category: MG91 effectors
  Description: MG91-635 effector
MSTKSFIINLPIITGDQDRRRLRKSFSFGCNLQNAVMGGGWDRVLKMRATPEWQTARAMPKSSERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPTRPRKVKYCRIVREMRKGKERFLLQLVAEGTSPLKHAYAGKDLRMAIDPGLGSLTYATEDGTIAKVQIAPSADTDHRAVRKLQRAMERSRQATNPDSYETVEVVRHGKKHKSLKVKSGRLQWRFSKRSESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRMGNDDDDRWIDRDAAACLNLLYADLEKQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3444 - protein, 528 aa, Unknown
  Description of Unknown: uncultivated organism sequence
  Category: MG91 effectors
  Description: MG91-636 effector
MNEVFVLELPLQVEKYQADVLNKRYEQLRQLYNYVQGKLLKQYRYFEQMKEYQACKTIKEKRDFFKNHPFQINEKQKSSEIPFNVYFDEYSLKGYIEKLVQKSVGPNMTYADLGFTTNILDHLGASVWAAWDKKLYDLKAKRISFKKYGELDSFSSRRKVVRGVVYFSGMELHLDSMELAIKMNGKVGKDAKFITLKMLHNPKHADYELWALKGGVDSVKVVKVVRRLVRSQYKYYVQLTIEGEKPQKGRTLGKGNVGIDLGPTTVAVSGVNVVSIDKLASKCDNIQEEITQLSRKIDRSRRANNPQNFNEDGTIKRGIKLVWSDSKRYKELRRELAELRRKQAVIRKQQHIERANALLKEGDTFIVENNPISSWTTRAKETKVNEKTGKIQKKKRFGKSVANHAPSMFVSILENKVKSLGGRFERVSTQNAASQYDFTTDTFKTGEEKHKLNERAITLSNGDTHQRDMLAAFNLQHLKYDEKDAKQYDTEAMTADYERFCQLEQEEILRYKNKVKKDDRSTIGAEKL

SEQ ID NO: 3445 - protein, 537 aa, Unknown
  Description of Unknown: uncultivated organism sequence
  Category: MG91 effectors
  Description: MG91-637 effector
MSTKSFIISLPIITGDQDRRRLRKSFSFGCNLQNAVMGGGWDCVLKMRATPEWQAARAMPKGSERTKAFRDLRVHFRLSEYDFHADVAKHRKASGRGHLLGINEGQKLASRAWISVERHLYNGGSPRFISSRRGLHSIEGKTNRTGIIWKADQQCVTVCKHVYRVRVDKRDDWLTRALQDPTDPTKPRKVKYCRIVREMRKGKERFLLQLVAEGTSPLKHAYAGKDLRMAIDPGLGSLTYATEDGTIAKVQIAPSADTDHRAVRKLQRAMERSRRATNPDNYEAVDVVRHGKKKKSFKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADLEKQTYAPERIREAVLAGVTAWLDAGVVVIQAREGITEREFGRFRRRGIPSLTVQGLRQQGFRGRSDSKSGTTPRRKASTESKPSHFSGEVV

SEQ ID NO: 3446 - protein, 484 aa, Unknown
  Description of Unknown: uncultivated organism sequence
  Category: MG91 effectors
  Description: MG91-638 effector
MAHKENQKAFVVTFPLRTEKWQEDRIDKMMRMLTTFYNDRQRKLVRRYIYLSHSKAYKEAKDKGVVVFKNYMKEHGFSQYGLDAFFKADTKGALYQCGLNSMFLQYLSQCAWSAWDKKLFGKGDFVKTDKVVNIFCSRNKKESFCGFDYDLSTFTISIKSTCTKKIICTIPFVVNKKSDYELFALSQRICRIGIVRKLIRGKYKYYVQFTFDGVPYHKGRNIGTGIVGIDPGPSKIAIVGDNKVEIAKLAPNIEEDERKTARLKRKLDRSRRATNPHMYKEDGTIIKGQRQTCFSKAYNETRKQLADAQRKLAAKRKIAHNELANTLLEYGDTFKVEANSYKSMQARAKATSMTKSGRIRSKKRYGKSIKNRAPSEFLVILKNKLLYYPKGKYYDVPSSYACTQFDFTNESFTEHKISERRIVTSDGIQHNRDTLAAFNIKNAIVNDTSTKKKKVTKSKEFLDIVKMKASYNEFCVMERYLLSV

SEQ ID NO: 3447 - protein, 609 aa, Unknown
  Description of Unknown: uncultivated organism sequence
  Category: MG91 effectors
  Description: MG91-639 effector
MSKENFVLTLPLKVEKWQADILDKRYELLRQVYNMVQQKLLRQYIYFSQQKAYKECGKDTKKKGKFFAEHPFFIKIDGKPCEVKFPTWKKSNQTASNSIAKYVSKLSSYKLGQDKTLSDFGINSYILEELGARIMKAWEDRLYKFKAKHISKREYGDVNSFSTRIKKSDNKISYPGFTINLEEGYITYNTNGRRGGFANLIKLPIDFSREKKGYAVEALKGGLESIREISVVRKYIRGKNKYYLQLTIDGEKPQKGRTLGRGNVGIDIGPSTIATSSLMGVHFDKLADKCDDIEHELYLVNRKLDRSRRATNPQNYNADGTFKTIKNRERRVWNYSNRYNKLKLVRKELFRRQAEIRKQQHLAMANALLSQGDTFIVENNPIDAWVRRAKETTKNKKGNYRCKKRYGKSVAHHAPAMFVSILENKVKSLGGELHKVDVGYAATQFDFTNGEFTKHAVNERSITLSNGHTHQRDMLSAFNLQHARLKTEGRNIEKTVDNYDIEQMNADYPIFCRLETAEQERFKAIRHYERDALFFVGVSNKHLRCQPQEETVANRHNGGVGRKDCNISLGSENAEITGNGLIRESIARVSQVPDECHPFAGKPIVLDGL

SEQ ID NO: 3448 - protein, 497 aa, Unknown
  Description of Unknown: uncultivated organism sequence
  Category: MG91 effectors
  Description: MG91-640 effector
MPSPTFIIELPIRVNDSESRTILRKLEFARQLHNATLGTALGQLQQLRQDSEWKRACLMPKGKERSELFRKLDRKYRLTEYDLHAVIAKHRQASGRKAELGINETQKIATRVFHAVNRYKLGLGGRPRFKSLSRGLRSIEGKSNKTGLKFNIEKSVLSWCKHDYRVFIDPQDDYLQRALRSEDRGGFKKVKYCRLVRKTIKGKNRFYLQVVLEGQAPIKHIYASTNERLSIDPGPQTIAVFSDVWAGKIKVSPNAQVDEKKIRRLQRSMDRSLRKSNPDCYENDGTLKKGCVLKKTKGCEKRIQRLQECHRKAVATRRCEHGQLINLLLSVAGDIRVEKNQWKAFQKGHFGKSLGKSGISGFIERLKSKAESAGLKVTEVKPYKLKLSQYDPYTDQYRKKSLNERWHSLGESSEWIQRDVMSALLLQCADLEEEKHIPTEVIKTLEGAKQLLRDAGYVILKPSSNGESNPAFASEPKAVTPEKVRLEIFCGASDSYL

SEQ ID NO: 3449 - protein, 491 aa, Unknown
  Description of Unknown: uncultivated organism sequence
  Category: MG91 effectors
  Description: MG91-641 effector
MRATPEWQAARAMPKGSERTKAFRDLRMRFRLSEYDFHADVAKHRKASGRGHLLGINECQKLASRAWISVERHLYNGGSPRFISSRRGLHSIEGKTNRTGIIWKADQQCVTVCKHVYRVRVDKRDDWLTRALQDPTDPKKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYETVEVVRHGKKHKSLKVKSGRLQWRFSKRYESLRAELAEIFRLSAATRKREHGEVCNWLLGHAGHIIVEDNSYKAFQRGRFGKTIGRHAPAALYAQLTNKAESAGLLVEVVSPKKLKPTQHNLLTGQFVKHELWERRVRLGEDDDERWIDRDAAACLNLLYADIENQTYAPERIREAVLAGVTAWLDAGVVVIQAREGITEREFGRFRRRGIPSLTVQGLRQQGFRGRSDSKSGATPRRKASTVSKPSHFSGEVV

SEQ ID NO: 3450 - protein, 588 aa, Unknown
  Description of Unknown: uncultivated organism sequence
  Category: MG91 effectors
  Description: MG91-642 effector
MVQRKLVRQYIYFAQQKEYKACENFQQRRDFFASHPFHFKGINSKNGEPADIKFPYTYESRSSNSGKRPSGGISDYVSKLWAHRVGADKTLANLGINSYILEELGLHIMKAWEKRLYDPRSSRVSFKDYGEVNSFGSRYKKDKQTGKVSFPGFTIYLEKDKNEVVKGGFITYNTNGKRSQPRPFVLPIDFSREKKDYAAYALKGGIDSLRKLIILRKNIRGRNKYYLQLTISGEKPQKGRTLGQGNVGIDIGPSTIATSSLQGVHFDKLADKCDNIEHELYLINRKMARSRYENNRQNYNADKTIKRGVRLVWKKDKDVKRYASLKLKRRELYRRQAEIRKLQHLEMANAMLSQGDTFIVENNPIDAWVRRAKETTKTKTGRNRCKKRYGKSVANHAPAMFVTILKNKVESLGGKFYEVDVRYAATQFDFTNGVKTKHEVSERSITLSNGRTHQRDMISAFNLQHIKLESIGTEVKEYDIEQMQADYPIFCRLEAAEQERFKMARHNERDALYFVGASEKQLRHQPQDESAANRHNGGVGRKHCNIRLGNENAEITGSGLVRESIERVSQVPDECHISGHQPIVLDGL

SEQ ID NO: 3451 - protein, 544 aa, Unknown
  Description of Unknown: uncultivated organism sequence
  Category: MG91 effectors
  Description: MG91-643 effector
MRVCCHHVVLITQKCRLLNKMNEVFVLELPLHVEKYQADILDKRYEQLRQLYNYVQGKLLRQYRYFEQMKEYQGCKTFKEKKDFFRSHPFKINETLKDSKTPFMVSFDEYSIKGFVEKLAQKSVGPNMAYSDLGFTTYILDHIGASIWAAWDKKLYDFKSNRISFKKHGELDSFSSRRKIVRGIVYFSGMELHLDTMELAIKINGKVGKEARFITLKMLHNPKHADYEMWALKGGVESVKVVKVVRRLVRSQYKYYVQLTIEGEKPQKGRTLGKGNVGIDLGPTTVTISGKNIVSIDKLASKCDNIQEEITRLSRKIDRTRRANNPQNFNEDGTVKRGIKLVWNDSKRYKELRRELTELRRKQAAIRKQQHIERANALLKEGDTFIVENNPVKAWSARKKETKIDEKTGKYKSKKGYGKSIGNHAPAMFIDILENKVKSLGGRLERVDTQNAASRFDFTDGSLTEHDRSERAITLSNGDTHQRDMLAAFNLQHLKLDEAKTKQYDTETMAADYKRFCQLEKEEIQRYKNKEKKDDRGTIGAGKL

SEQ ID NO: 3452 - protein, 525 aa, Unknown
  Description of Unknown: uncultivated organism sequence
  Category: MG91 effectors
  Description: MG91-644 effector
MNEVFVLELPLQVEKYQADLLNKRYEQLRQLYNYVQGKLLRQYRYFEQMKEYQACKTIKVKRDFFKNHPFQINETQKGSEIPFKVSFDEYSIKGYIEKLVQKPVGPNMTYADLGFTTNILDHLGASIWAAWDKKLYDFKAKRISFKKYGELDSFSSRRKVVRGVVYFSGMELHLDTMELAIKMNGKVGKEAKFITLKILHNPKHAEYEMWALKGGVDSVKVVKVVRRLVRSQYKYYVQLTIEGEKPQKGRTLGKGNVGIDLGPTTVAVSGMNIVSIDKLASKCDNIQPKITRLSRKLDRSRRANNPDNYNEDGTIKRGVKLVWKKEKDLKRYSKLKRELAELRRKQAAIRKQQHIDRANELLKEGDTFIVENNQISGWTTRAKETKVNEKTGKIQKKKRFGKSVANHAPSMFVSILENKVKSLGGEVMKVDTKNAASQYDFTDNSFTKHELKERNVTLSNGDTHQRDMLAAFNLQHLKLEGTKQYDTEAMAADYVRFCQLEQEEIQRYKNKEKKNDRGTIGAEKL

SEQ ID NO: 3453 - protein, 530 aa, Unknown
  Description of Unknown: uncultivated organism sequence
  Category: MG91 effectors
  Description: MG91-645 effector
MTSQSFVIELPIAVDDAEMRTIVRKLEFARQLHNATLGTAMGQLQQMRQDAAWKEACVMPKGKERAAAFRALDCKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYIQRALKENERSDKYRKIKYCRLVRKRIRSSDRFFLQVVLEGTAPVKHVYAPVTERAAIDPGPQSIALFSKEFAGKIQVAGSNNFNEAVSRRLLRAMDRSLRRNNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVTEVNPYKLRLSQYDPYTDTYRKKDLSERWQEMKAGSGLYIQRDILSALLLYCADIEKEIHIPKVAVEQLEGTKQFLTDAGYVVLKSTSSRDQRDPRLASEPKAMTPEMARQKILRGAGDSHLPTDQELGQIRAGGKVSTWSKETFPLQRGVV

SEQ ID NO: 3454 - protein, 539 aa, Unknown
  Description of Unknown: uncultivated organism sequence
  Category: MG91 effectors
  Description: MG91-646 effector
MNEVFVLELPLQVEKYQADILNKRYEQLRQLYNYVQGKLLRQYRYFEQMREFQTCKTFKEKKDFFRRHPFHIDGILGSNKELFDITFDEYGINGFVGKLGKKQVSAGVTYADLGITSTLLDRMSLAVWAAWDKMLYDYHARRVSFKKHGELNIFGSRKKTNGSGKKVFSGMELHLEKMEVAIKLNGKVGKAAKFITLPILHNPKHEDYEMWALKGGFDSVTVLTIVRRLVRGQYKYYVQLTIEGEKPQKGRTLGKGNVGIDLGPTTVAVSGENVVSIDKLASKCDNSQEEITRLSRKIDRSRRANNPQNFNEDGTIKRGVKLVWNDSKRYKELRRELAELRRKQAAIRKQQHIDRANALLKEGDTFIVENNPVKAWSAKKKETKIDEKTGRYKSKKGYGKSVGNHAPAMFVDILENKVKSLGGRFERVNTQNAASQYDFTTDSFKTGDEKHKLNERAITLSNGDTHQRDMLAAFNLQHLKLDEAKTKQYNTEAMKADYERFCEMEQEEIMRYKNLEKKDDRATIGAVDLWKESDEMKKE

SEQ ID NO: 3455 - protein, 530 aa, Unknown
  Description of Unknown: uncultivated organism sequence
  Category: MG91 effectors
  Description: MG91-647 effector
MNEVFVLELPLQVEKFQTDILNKRYEQLRQLYNYVQGKLLRQYRYFEQMKEYQACEKFREKKDFFKSHPFHINETLKGNKTPIKVSFDEYSIKGYIEKLAQKPVGPNMTYADIGFTTYILDHLGASIWSAWDKKLYDFKAKRISFKKYGELDSFSSRRKVVRGIVYFSGMELHLDTMELAIKLNGKVGKEAKFITLKILHNPKHADYEMWALKGGLESIKVVKVVRRMVRSQYKYYVQLTIEGEKPQKGRTLGKGRVGIDLGPTTVAISSENVVSIDKLASKCDNIQDEITKLSRKIDRSRRANNPQNFNEDGTIKRGIKLVWNDSKRYKELRRELAELRRKQAAIRKLQHIERANALLKEGDTFIVENNPVNAWVRRAKETKIDEKTGKYKSKRGSGRSVGNHAPAMFVDILENKVKSLGGRFERVTTQNAASQYDFTTDSFKTGDEKHKLNERAITLSNGDTHQRDMLAAFNLQHLKLDEAKTKQYDTEAMAADYERFCQLEQEEIMRYKNKEKKGDRGTIGAEYIHK

SEQ ID NO: 3456 - protein, 544 aa, Unknown
  Description of Unknown: uncultivated organism sequence
  Category: MG91 effectors
  Description: MG91-649 effector
MNLDSRVMNVSPRIVIRQSKVKEVFVLELPLRVEKYQADLLNKRFEQLRQLYNYVQGKLLRQYRYFEQMKEYQACKTFKEKKDFFRKHPFHINGILGSNKKPLNITFDEYGIRGFVEKLVQKGVGASMTYADLGFTTSILDHLSSGIWSAWDKMLYDYKARRISFRKYGELDSFSSRRKVVQGKIYFSGMELHLDSMMLSVKMNGKVGKAAKFITLPILHNPKHADYEMWALKGGLDSIKVVKVVRRMVRGRYKYYLQMSIESEKPLKGRKLGKGNVGIDLGPTTVAVSGENIASIDKLASKCDSIETEKAKLGRKIDRSRRANNPQNFNEDGTIKRGVRLVWNDSKRYKALRGEMAELQRRQSAIRKQQHIDRANELLKEGDIFIVENNQISGWTRKAKETRVDESTGRIRKKKRFGKSVANHAPSMFVNILENKVKSLGGQLVKVDTQNAASQYDFTDGSFTKHELQERNVTLSNGDTHQRDMLAAFNLQHLKYDEAEKKQYDREAMSKHYERFCELEQAEILRYKNKEKVDDRSTIGAKEL

SEQ ID NO: 3457 - protein, 507 aa, Unknown
  Description of Unknown: uncultivated organism sequence
  Category: MG91 effectors
  Description: MG91-650 effector
MKEQILSYELTLPQRIYPHLERLFSVFKNQVNSYIPKLWNEEGFKLLSQKSHAWGILKKEFPTPIGLPSRVFRNVLELTGQIIRSQIERKEVFEKLLRREELKGYDKRFVLNVQRQIENLRKKGKEVSCYFDLPYPEFDGNVVITSADDNFEKGQFRRLKISGNFLEFSIKVPTQKGWEWIKVKKLIPERLRKALMKAKEVKAVLIKKVLLKSGYNIYRLVIPLSFEVKEPEKVERVLALDLSPSEKRLGVAVLVEGEEVSKPLFFKTLMLRKVERLYFEVSNLERKIDNIYNSIEKTACKREKKRLWERLRHLFAEQKLKQRKIKQLRKQILETFTNLIVSHAKAYHCQAIVIEDLSFKEVPGWKNKPALRRFSQWFFSRFTSRLEEKAKFHNLKVMKVNPAYTSRVCHKCGKEGELEGLVFKCSCGTYDRDYNASVNIAFRLTKPKAQRAEGIPGRIPSRLVRVEWKALLSFISFSKLLAWLRIVETSQLKLKKLLKWIGSDKYD

SEQ ID NO: 3458 - protein, 531 aa, Unknown
  Description of Unknown: uncultivated organism sequence
  Category: MG91 effectors
  Description: MG91-651 effector
MNEVFVLELPLQVEKYQADILNKRYEQLRQLYNYVQGKLLRQYRYFEQMKEFQDCKTFKAKREFIKAHPFQIKGVMGRNKELLDIFFDEYGILGLITKLGQKPIGSGKTYTDMGISSTILANLSNSIWSSWNKKLYDYHADRISFKKYGGLNTFGSGKIIQKKDNEVKEYFPGMVLHLDRMEIDIKTNGGLGKKATFITLPILHNPKHADYEMNALSGGSSSIKVLTIVRRMIRGQYKYYLQMSIEGEKPQKGRLLGKGNVGIDLGPTTVAVSGENIVSIDKLASKCDDIQEVITRLSRKIDRSRRANNPQNFNEDGTIKRGIKLVWNDSKRYKELRRELAELRRKQAAIRKQQHIDRANALLKEGDTFIVENNQISSWTTRAKETKVNEKTGKIQKKKRFGKSVANHAPSMFVSILENKVKSLGGKVVKVDTKNAASQYDFTDGSFTKHELKERNVTLSNGDTHQRDMLAAFNLQHLKYNEAEAKQYDTEAMAADYERFCQLEQEEILRYKNKEKKDDRSTIGAEELLKT

SEQ ID NO: 3459 - protein, 525 aa, Unknown
  Description of Unknown: uncultivated organism sequence
  Category: MG91 effectors
  Description: MG91-652 effector
MTSQSFVIELPIAVDDAEMRTIVRKLEFARQLHNATLGTAMGQLQQMRQDAAWKEACVMPKGKERAAAFRALDRKYGLTEYDLHSVIARHREGSGRKAELGINETQKIATRVFQAINRYKLGLGGMPRFKSSKRGLHSIEGKTNKTGLKFRPEKKVLNWCGHDYRVLIDPKDDYVQRALKENERSDQYRKIKYCRLVRKRIRSADRFFLQVVLEGTAPVKHVYAPVTERAAIDPGPQSIALFSKAFAGKIQVAGSNNFNEAASRRLLRAMDRSLRRNNPDAYNEDGTIKKGAKLVKSKNYQRKVDRLREMHRVVAAERKCRHGQTINLLLSIAGDIRIEKNSWKAFQRGHFGKSLGKSAMSGFIAQLKSKAASAGLKVTEVNPYKLKLSQYDPYTDTYRKKDLSERWQEMKAGSGQYIQRDILSALLLYCADIEKEIHIPKAAVEQLEGAKQFLTDAGYVVLKSTSSRDQRDLRLAPEPKAMTPEMARQKILRGAGDSHLPTDQALGRIRAGGKVSTWSKETFPL

SEQ ID NO: 3460 - protein, 510 aa, Unknown
  Description of Unknown: uncultivated organism sequence
  Category: MG91 effectors
  Description: MG91-653 effector
MKEQILSYELTLPQRIYPHLDRLFSVFRSQVNSYIQELWNEKGFELLSQKGSAVGILKEVFPTPECVPSRVFRNILELTGQIIRGQIERKEVFEKLLKEEKVKGYSKNLVLNVQRQIENLRRKGKEVSCYFDLPHPEFDGRIVITSADDNLEKGQFRRVKVDRNFLTFEIKVPMQDGWEWIKVRKFLPGRLRKALLRAKEIQVPLIKRQRLKSGYTIYRLVIPLVFKVKEPEKVERVFAIDLSPGERRLGVGIVMDDEFVSKPIFFKTNLIKKVERIHKEISNLERKIDNIHNAIEDANSKRVKETLFKRLNHLFGEQKRKQRKIKELRKQILETFTNLAIAYAKAYHCQAVAIEKLVFKEVPSWQSSKALRLFTQWFYSKFAKRLEEKARVNELKVIKVNPAYTSKACAKCGREGEFEGLKFICFCGVYDRDYNASLSIAKRALRPTKPEAQGAEGIPGRIPSRLVRMEGSALLTMISLFKLLAWLKVVHTCCLKPQKLFKWIRSDKYG

SEQ ID NO: 3461 - protein, 537 aa, Unknown
  Description of Unknown: uncultivated organism sequence
  Category: MG91 effectors
  Description: MG91-654 effector
MSTKSFTINLPIITGDQDRRRLRKSFSFGCNLQNAVMGGGWDRVLKMRATAEWQTARAMPKSSERTKAFRDLRVRFRLSEYDFHADVAKHRKASGRGHLLGINECQKLASRAWISVERHLYNGGSPRFISSRRGLHSIEGKTNRTGIIWKADQQCVTVCKHVYRVRVDKSDDWLTRALQDPTDPTKPRKVKYCRIVREMRKGKERFLLQLVAEGTSPLKHAYAGKDLRMAIDPGLGSLTYATEDGTIAKVQIAPSADTDHRAIRRIQRAMERSRRATNPDNYEAVDVVRHGKKHKSLKVKSGRLQWRFSKRYESLRAELAEIFRLSAATRKREHGEVCNWLLGHAGHIIVEDNSYKAFQRGRFGKTIGRHAPVALYAQLASKAESAGLLVEVVSPKKVKPTQHNLLTDTFVKHELWERRVRLGNDDDDRWIDRDAAACLNLLYADLEKQTYAPERIREAVLAGVTAWLDAGVVVIQAREGITEREFGRFRRRGIPSLTVQGLRQQGFRGRSDSKSGTTPRRKASTVSKPSNFRGEVV

SEQ ID NO: 3462 - protein, 511 aa, Unknown
  Description of Unknown: uncultivated organism sequence
  Category: MG91 effectors
  Description: MG91-655 effector
MGGMRAIRIAVMTSQSFIVELPIVVDDSERRTIVQKLEYARQLHNATLGTALGQLQQMRQDTAWRQARSMPQGKERTEIFRALDRQYKLTEYDLHAVIARHREESGRKAELGINETQKIATRVYQSVNRYKLGLGGCPRFKSFKRGLHSIEGKTNKTGLKFKPEQSVLSWCGHDYRVLIDPKDDYLQRALKADGQGTGYRKIKYCRLVRRRIRSKEYFYLQVVLEGTAPVKHIYASTNERLAIDPGPQTIAVFSNMFIGKIRVAGNYQLQDAQIRRLQRSMDRSLRANNKDANEENGTLKKGAKLVQTKGYLTRAARLRELHRKAAMHRKCQHGQTVNLLLSIAGDIRIEKNNWKAFQRGHFGKSLGKSAMSGFFNQLRTKAESAGLKVTEVNPYKLKLSQYDPYTETYRKKDLKERWQEMQPGSGQYIQRDVLSALLLLCADLEEEKHIPKAALDRLEGAKQLLKGAGYVIDKPTSNPDQPDPRFAPEPKALTPERARLEILCGTGDSCL

SEQ ID NO: 3463 - protein, 525 aa, Unknown
  Description of Unknown: uncultivated organism sequence
  Category: MG91 effectors
  Description: MG91-656 effector
MEEVFVLELPLQVEKYQEDILNKRYEQLRQLYNYIQGKLLRQYRYFEQMKEFQVCKTFKEKRDFFRNHPFHINGVYGNNKELLDITFDEYGINGFVGKMGKKLVNADTTYADLGITSTLLDRLSLAIWAAWEKMLYDYHAKRISFKKYGELNIFGSRKKTNGSGKKMFSGMELHLETMTLAVKLNGKVGKKAKFITLPILHNPKHVDYEMMALKGGFDSVKVITVVRRMVRERYKYYLQMSIEGEKPQKGRTLGKGNVGIDLGPTTVAVSGENIVSIDKLASKCDNIQAEITRLARKIDRSRRANNPQNFNEDGTIKRGVRLTWNDSKRYKALRREMAELQRRQAAIRKQQHINRANALLKEGDTFIVENNQISGWTRKAKETKVNEKTGKIQKKKRFGKSVANHAPAMFVTILENKVKSLGGEVVKVDTQNAASQYDFTNNNFKKHELNERSVTLSNGDTHQRDMLAAFNLQHLKYDEAEKKQYDREAMSKHYERFCELEQAEIVRYKNKEKADDRSTIGAKEL

SEQ ID NO: 3464 - protein, 612 aa, Unknown
  Description of Unknown: uncultivated organism sequence
  Category: MG91 effectors
  Description: MG91-657 effector
MAKETFVLTLPLKVEKWQADILDKRYELLRQTYNMVHRKLLCQYIYFSQQKAYKACENFQQRREFFESHPFHFKGINGKNGEPSDIKFPYTYESRSSNSGKRPSGGISDYVSKLWSHRVGQDKTLADFGLNGSILEELGLHVMSAWGKRLYDPKASRVSFKEYGDINSFGCRYHKGNFAGFTINLEEGYITYNTNCRRGRFADIIQLPIDFSREKKDYAVYALRGGIDSLRKLIILRKNIRGRNKYYLQLTINGEKPQKGRTLGRGNVGIDIGPSTIATSSLQGVHFDKLADKCDNIEHELYLIGRKMDRSRRANNPQNYNPDGTIKRGVRLTWKKDSEAKRYASLKQKRRELYRRQAEIRKLQHLEMANAMLSQGDTFIVENNPIDAWVRRAKETTKTKTGRNRCKKRYGKSVANHAPAMFVSILKNKVLSLGGAFHEVDVRYAATQFDFTNGVKTKHEVGERRITLSNGRTHQRDMISAFNLQHIKLESIGTEVKEYDIEQMQADYPIFCQLEAAEQERFKEARHAERDALYFIGAQEKQLRHQPQDESVANRHNGGVGRKHCNTRLGSRSKENAKITGSGLVRESIARVSQVPDECHPVGDHPIILDGL

SEQ ID NO: 3465 - protein, 607 aa, Unknown
  Description of Unknown: uncultivated organism sequence
  Category: MG91 effectors
  Description: MG91-658 effector
MAKEEFVLTLPLKVEKWQADILDKRYEMLRQVYNMVQQKLVRQYIYFSQQKAYRDCKNFEQRREFFENHPFHIKGVKGKNGELCDIKFPYTFKSRGGPSGKRAPNGISDYVSKLWSHKIGQNKTLSDYGINSYIMEELGLHIMKAWEDRLYKPKSKRVSFKDYGEINSFGSRKKNGIFVGFTINLDNGIITYKTNGRLGQFADLIQLPIDFCREKSGYAKEALKGGIESLKKLLIVRRYIRGGNKYYLQLTISGEKPQKGRTLGKGNVGIDIGPSTIATSSLKGVHFDKLANKCDNIEHELYLINRKLDRSRRANNPQNYNEDGTIKRGIRLVWKKDKDVKRYATLKQQRKELYRKQAEIRKHQHLEMANAMLSQGDTFIVENNPVDAWVRRAKETTKTKAGKNRCKKRYGRSVANHAPAMFVSILKNKVLSLGGNFYEIDPRNAATQFDFTNGKFTKHEVRERSITLSNGCTHQRDMLSAFNLQHIVLQSKELKEYDIEQMKADYPIFCRLESAEQERFRIARHNERDALYFVGASEKQMRRQPQEKTVANHHNGGVDRKYCNTSLESENVKITGSGLVRESIERVSQVPDECHLFGCDPIVLDGL

SEQ ID NO: 3466 - protein, 524 aa, Unknown
  Description of Unknown: uncultivated organism sequence
  Category: MG91 effectors
  Description: MG91-659 effector
MKEVFVLDLPLRVEKYQSDILNKRFEQLRQLYNYVQGKLLRQYRYFEQMKEYQACKTFKEKKDFFRNHPFHINGILGSNKELLDITFDEYGIKGFVEKLVQKGVGTDMTYADLGFTTYILDHLSAGIWSAWDKMLYDYKARRISFKKYGELDSFSSRRKVVQGKVYFSGMELHLDSMMLSVKMNGKVGKAAKFITLPILHNPKHADYEMWALKGGLDSIKVVKVVRRMVRGRYKYYLQMSIESEKPLKGRKLGKGNVGIDLGPTTVAVSGENIASIDKLASKCDSIETEKAKLGRKIDRSRRANNPQNFNEDGTIKRGVRLVWNDSKRYKALRGEMAELQRRQSAIRKQQHIDRANELLKEGDIFIVENNQISGWTRKAKETRVDESTGRIRKKKRFGKSVANHAPSMFVNILENKVKSLGGQLVKVDTQNAASQYDFTDGSFTKHELQERNVTLSNGDTHQRDMLAAFNLQHLKYDEAEKKQYDREAMSKHYERFCELEQAEILRYKNKEKVDDRSTIGAKEL

SEQ ID NO: 3467 - protein, 529 aa, Unknown
  Description of Unknown: uncultivated organism sequence
  Category: MG91 effectors
  Description: MG91-660 effector
MKEVFVLELPLQVEKYQADILNKRYEQLRQLYNYVQGKLLRQYRYFEQMKDYQACKAFKEKREFFKTHPFHINGVLGRNKELLDITFNEYGILGWVTKLGQMSIGSGKTYADIGITARILANLSDNIWSAWNKKLYDYRSERISFKKYGSLNTFGSGKTILKKGKEIKEYFSGMVLHLERMEIDIKTNGSNGKNATFISLPILHNPKHADYEMMALSGGSSSIKVLTIVRRLVRGQYKYYLQLSIEGEKPQKGRTLGKGNVGIDLGPTTIAVSGENVVSIDKLASKCDNIQTEITKLARKIDRSRRANNPQNFNEDGTIKRGIKLVWNDSKRYKELRRELAELCRKQAAIRKQQHIDRANALLKEGDTFIVENNPVKAWAARAKETKVNEKTGKIQSKKRGGKSIGNHAPAMFVDILENKVKSLGGTFIRANTNNAASQYDFSNNSFKEGEDRHGLNERAITLSNGNTHQRDMLAAFNLQHLTDEKKQYDVEAMKRDYERFCQLEQEEIQRYKNKEKKDDRGTIGAEKL

SEQ ID NO: 3468 - protein, 472 aa, Unknown
  Description of Unknown: uncultivated organism sequence
  Category: MG91 effectors
  Description: MG91-662 effector
MPKGKERAAAFRALDRKYGLTEYDLHSVIARHREGTGRKAELGINETQKIATRVFQAINRYKLGLGGMPRFKSFKRGLHSIEGKTNKTGLKFKPEQKVLNWCGHDYRVLIDPKDDYIQRALKDNERSDQYRKIKYCRLVRRRIRSADRFFLQVVLEGTAPVKHVYAPVTERAAIDPGPQSIALFSKAFAGKIQVAGSNNFNEAASRRLLRAMDRSLRRNNPDAYNEDGTINKGVKLAKSKNYQRKVDRLHEMHRVAAAQRKCRHGQTINLLLSIAGDIRIEKNSWKAFQRGHFGKSLGKSAMSGFIAQLKSKAESAGLKVTEVNPYKLKLSQYDPYTDTYRKKDLSERWQEMKAGSGQYIQRDVLSALLLYCADIEKEIHIPKAAVEQLEGAKQLLTDAGYVVLKSTSSRDQRDPRLASEPKAMTPEMARQKILRGAGDSHLPTDQALGRIRAGEKVSTWSKETFPLQRGVV

SEQ ID NO: 3469 - protein, 525 aa, Unknown
  Description of Unknown: uncultivated organism sequence
  Category: MG91 effectors
  Description: MG91-663 effector
MTSQSFVIELPIALDDAEMRTIVRKLEFARQLHNATLGTAMGQLQQMRQDAAWKEACVMPKGKERAAAFRALDRKYGLTEYDLHSVIARHREGTGRKAELGINETQKIATRVFQAINRYKLGLGGMPRFKSSKRGLHSIEGKTNKTGLKFRPEKKVLNWCGHDYRVLIDPKDDYVQRALKENERSDQYRKIKYCRLVRKRIRSADRFFLQVVLEGTAPVKHVYAPVTERAAIDPGPQSIALFSKAFAGKIQVAGSNNFNEAASRRLLRAMDRSLRRSNPDAYNEDGTIKKGAKLVKSKNYQRKVDRLREMHRVAAAERKCRHGQTINLLLSIAGDIRIEKNSWKAFQRGHFGKSLGKSAMSGFIAQLKSKAASAGLKVKEVNHYKLKLSQYDPYTDTYRKKDLSERWQEMKAGSGQYIQRDILSALLLYCADIEKEIHIPKVAVEQLEGAKQFLTDAGYVVLKSTSSRDQRDLRLAPEPKAMTPEMARQKILRGAGDSHLPTDQALGRIRAGGKVSTWSKETFPL

SEQ ID NO: 3470 - protein, 1128 aa, Unknown
  Description of Unknown: uncultivated organism sequence
  Category: MG91 effectors
  Description: MG91-664 effector
MNKKILSLDLGITSIGYSVIEEFDNDRYSLLDYGVSMFDKATDKDGNSKKILHSQSESSSKLFNLRKQRKKDLSILFDNFKLANKDKLLIQEKQNIYKNKWQLRCVKAFEQKLSINELFTIFYTIAKHRGYKSLESSDLLDELCEELNIPLEITKSNKNEDEKGKIKKSLKNVEELKQNSNKTVASIIYDIEIQKNNPTFRNHDNYNYMIRREYIEEEIINIVKSQVKFGLFESSFNSDIFIQKLKDIITYQNPSTNDMSLFGDCEFYPQFKVANQYSIISDIYKMYQSVSNITFNSKPTIKITKEQINLVANDFFTKLKKGKNILDLKYKDIRKILNLSDDIKIFNKDDDYISKGKKVHHTITKFHFINNLSKFDTNFIINNLSNENGYKNLKEIFEALQFEKDPTEIYKKLKDKIEDNQTIIYLIKYKSGNSLNISAEAMIKFIPYFKDGYTTDEIKEKLKLNRSEDYSEFKKGIKYLHINQFEKDNNNLKITNHPVKYVVSATLRVVKHLHNVYGSFDEIRVESTRELSQNEETKKAIEKANRELEKQIDTIVQNNEYQIIAKQYGKNLQKYARKILMYESQDRRDIYTGKGIEFKDIFTNTVDLDHIVPQSLGGLSVKHNFVLVHKDTNIQKSNQLPLNFVKDKEDFINRVEYLFAEHKINWKMKKNLLSNSLEETYKDTFESKSLRATSYIEALTAQVLKRYYPFKDIKKQKDGSSVRHIQGRATSNIRKILKVKTKIRDTNIHHAIDAILIGMTNQSWLKKLSDTFKNNMGVIDDKARANIKKDIPIFEIIINNEVKYLEPKELVNLIEDNYNFDGENSIFYKDIWGKTKSINFWVSKKPMVSKIHKDTIYSKKDNGIYTVRESIINHFINLKITPTTLSKKFEEEFNKKILNKMYLYKTNPNDIIYKIVQQRANDIKVLLDSFMLEDTKDKETLSILKTNLDNLIHSDLLDNNNNIIKKVKFYQTNLTGFNVRGGLATKEKTFIGFKATLENDKLNYTRIDVANIDKIKKDNDNSFKVYKNDLVFFVYPDKSYKGGKIVSFLEDKKIGAFQNPRFPATIQFQPFNFCKLGSGKKVGTKQQALAQTIGIIKLNLDILGNIKSYQKIGQCNSDILEHIKTIKG

SEQ ID NO: 3471 - RNA, 43 nt, Artificial Sequence
  Description of Artificial Sequence: Synthetic oligonucleotide
  Category: MG11 effectors crRNA
  Description: MG11-1 effector crRNA
  modified_base (20)..(43): a, c, u, g, unknown or other
gaauaccugcuaaugcaggnnnnnnnnnnnnnnnnnnnnnnnn

SEQ ID NO: 3472 - DNA, 31 bp, Unknown
  Description of Unknown: uncultivated organism sequence
  Category: MG11 effectors repeat
  Description: MG11-1 effector repeat
gtaacattacacgaatacctgctaatgcagg

SEQ ID NO: 3473 - DNA, 31 bp, Unknown; identical to SEQ ID NO: 3472
  Description of Unknown: uncultivated organism sequence
  Category: MG11 effectors repeat
  Description: MG11-1 effector repeat

SEQ ID NO: 3474 - DNA, 31 bp, Unknown; identical to SEQ ID NO: 3472
  Description of Unknown: uncultivated organism sequence
  Category: MG11 effectors repeat
  Description: MG11-1 effector repeat

SEQ ID NO: 3475 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3476 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3477 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3478 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3479 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3480 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3481 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3482 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3483 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3484 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3485 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3486 - DNA, 25 bp, Unknown
  Description of Unknown: uncultivated organism sequence
  Category: MG11 effectors repeat
  Description: MG11-2 effector repeat
aaaatagaatttctacttgtgtaga

SEQ ID NO: 3487 - DNA, 37 bp, Unknown
  Description of Unknown: uncultivated organism sequence
  Category: MG11 effectors repeat
  Description: MG11-3 effector repeat
ggctataaggccatattaatttctactattcgtagat

SEQ ID NO: 3488 - DNA, 37 bp, Unknown; identical to SEQ ID NO: 3487
  Description of Unknown: uncultivated organism sequence
  Category: MG11 effectors repeat
  Description: MG11-3 effector repeat

SEQ ID NO: 3489 - DNA, 37 bp, Unknown; identical to SEQ ID NO: 3487
  Description of Unknown: uncultivated organism sequence
  Category: MG11 effectors repeat
  Description: MG11-3 effector repeat

SEQ ID NO: 3490 - DNA, 37 bp, Unknown; identical to SEQ ID NO: 3487
  Description of Unknown: uncultivated organism sequence
  Category: MG11 effectors repeat
  Description: MG11-3 effector repeat

SEQ ID NO: 3491 - DNA, 36 bp, Unknown
  Description of Unknown: uncultivated organism sequence
  Category: MG11 effectors repeat
  Description: MG11-5 effector repeat
ggtgtaaaaccatatcaaatttctactaatgtagat

SEQ ID NO: 3492 - DNA, 36 bp, Unknown; identical to SEQ ID NO: 3491
  Description of Unknown: uncultivated organism sequence
  Category: MG11 effectors repeat
  Description: MG11-5 effector repeat

SEQ ID NO: 3493 - DNA, 36 bp, Unknown; identical to SEQ ID NO: 3491
  Description of Unknown: uncultivated organism sequence
  Category: MG11 effectors repeat
  Description: MG11-5 effector repeat

SEQ ID NO: 3494 - DNA, 36 bp, Unknown
  Description of Unknown: uncultivated organism sequence
  Category: MG11 effectors repeat
  Description: MG11-6 effector repeat
ggtgtaagaccactgaaaatttctacttgtgtagat

SEQ ID NO: 3495 - DNA, 36 bp, Unknown
  Description of Unknown: uncultivated organism sequence
  Category: MG11 effectors repeat
  Description: MG11-7 effector repeat
ggctataaagccattttaatttctactattgtagat

SEQ ID NO: 3496 - DNA, 36 bp, Unknown; identical to SEQ ID NO: 3495
  Description of Unknown: uncultivated organism sequence
  Category: MG11 effectors repeat
  Description: MG11-7 effector repeat

SEQ ID NO: 3497 - DNA, 20 bp, Unknown
  Description of Unknown: uncultivated organism sequence
  Category: MG11 effectors repeat
  Description: MG11-8 effector repeat
aaatatctacttctgtagat

SEQ ID NO: 3498 - DNA, 20 bp, Unknown
  Description of Unknown: uncultivated organism sequence
  Category: MG11 effectors repeat
  Description: MG11-8 effector repeat
aaatatctacttctgtagat

SEQ ID NO: 3499 - DNA, 32 bp, Unknown
  Description of Unknown: uncultivated organism sequence
  Category: MG11 effectors repeat
  Description: MG11-10 effector repeat
gcaacattacatgaatacctgctaatgcaggc

SEQ ID NO: 3500 - DNA, 32 bp, Unknown; identical to SEQ ID NO: 3499
  Description of Unknown: uncultivated organism sequence
  Category: MG11 effectors repeat
  Description: MG11-10 effector repeat

SEQ ID NO: 3501 - DNA, 32 bp, Unknown; identical to SEQ ID NO: 3499
  Description of Unknown: uncultivated organism sequence
  Category: MG11 effectors repeat
  Description: MG11-10 effector repeat

SEQ ID NO: 3502 - DNA, 32 bp, Unknown; identical to SEQ ID NO: 3499
  Description of Unknown: uncultivated organism sequence
  Category: MG11 effectors repeat
  Description: MG11-10 effector repeat

SEQ ID NO: 3503 - DNA, 32 bp, Unknown; identical to SEQ ID NO: 3499
  Description of Unknown: uncultivated organism sequence
  Category: MG11 effectors repeat
  Description: MG11-10 effector repeat

SEQ ID NO: 3504 - DNA, 32 bp, Unknown; identical to SEQ ID NO: 3499
  Description of Unknown: uncultivated organism sequence
  Category: MG11 effectors repeat
  Description: MG11-10 effector repeat

SEQ ID NO: 3505 - DNA, 20 bp, Unknown
  Description of Unknown: uncultivated organism sequence
  Category: MG11 effectors repeat
  Description: MG11-11 effector repeat
gaatacctgctaatgcaggc

SEQ ID NO: 3506 - DNA, 20 bp, Unknown
  Description of Unknown: uncultivated organism sequence
  Category: MG11 effectors repeat
  Description: MG11-11 effector repeat
gaatacctgctaatgcaggc

SEQ ID NO: 3507 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3508 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3509 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3510 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3511 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3512 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3513 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3514 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3515 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3516 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3517 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3518 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3519 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3520 - DNA, 20 bp, Unknown
  Description of Unknown: uncultivated organism sequence
  Category: MG11 effectors repeat
  Description: MG11-12 effector repeat
aaatacctgctaatgcaggc

SEQ ID NO: 3521 - DNA, 37 bp, Unknown
  Description of Unknown: uncultivated organism sequence
  Category: MG11 effectors repeat
  Description: MG11-13 effector repeat
ggctataagaccatattaatttctactattcgtagac

SEQ ID NO: 3522 - DNA, 37 bp, Unknown; identical to SEQ ID NO: 3521
  Description of Unknown: uncultivated organism sequence
  Category: MG11 effectors repeat
  Description: MG11-13 effector repeat

SEQ ID NO: 3523 - DNA, 37 bp, Unknown
  Description of Unknown: uncultivated organism sequence
  Category: MG11 effectors repeat
  Description: MG11-14 effector repeat
ggctataaggccatattaatttctactattcgtagac

SEQ ID NO: 3524 - DNA, 37 bp, Unknown; identical to SEQ ID NO: 3523
  Description of Unknown: uncultivated organism sequence
  Category: MG11 effectors repeat
  Description: MG11-14 effector repeat

SEQ ID NO: 3525 - DNA, 36 bp, Unknown
  Description of Unknown: uncultivated organism sequence
  Category: MG11 effectors repeat
  Description: MG11-15 effector repeat
ggctatatgccaatataatttctactttacgtagat

SEQ ID NO: 3526 - DNA, 36 bp, Unknown
  Description of Unknown: uncultivated organism sequence
  Category: MG11 effectors repeat
  Description: MG11-16 effector repeat
ggctataaaccggtataatttctactattcgtagat

SEQ ID NO: 3527 - DNA, 36 bp, Unknown; identical to SEQ ID NO: 3526
  Description of Unknown: uncultivated organism sequence
  Category: MG11 effectors repeat
  Description: MG11-16 effector repeat

SEQ ID NO: 3528 - DNA, 36 bp, Unknown; identical to SEQ ID NO: 3526
  Description of Unknown: uncultivated organism sequence
  Category: MG11 effectors repeat
  Description: MG11-16 effector repeat

SEQ ID NO: 3529 - DNA, 35 bp, Unknown
  Description of Unknown: uncultivated organism sequence
  Category: MG11 effectors repeat
  Description: MG11-17 effector repeat
gtttataagtaatatttaatttctactttcgtaga

SEQ ID NO: 3530 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3531 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3532 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3533 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3534 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3535 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3536 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3537 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3538 - DNA, 35 bp, Unknown; identical to SEQ ID NO: 3529
  Description of Unknown: uncultivated organism sequence
  Category: MG11 effectors repeat
  Description: MG11-17 effector repeat

SEQ ID NO: 3539 - skipped

SEQ ID NO: 3540 - DNA, 36 bp, Unknown
  Description of Unknown: uncultivated organism sequence
  Category: MG13 effectors repeat
  Description: MG13-1 effector repeat
ggctataaagcctatttaatttctactgttgtagat

SEQ ID NO: 3541 - DNA, 36 bp, Unknown
  Description of Unknown: uncultivated organism sequence
  Category: MG13 effectors repeat
  Description: MG13-3 effector repeat
gactataaatcctatttaatttctactattgtagat

SEQ ID NO: 3542 - DNA, 36 bp, Unknown; identical to SEQ ID NO: 3541
  Description of Unknown: uncultivated organism sequence
  Category: MG13 effectors repeat
  Description: MG13-3 effector repeat

SEQ ID NO: 3543 - DNA, 36 bp, Unknown; identical to SEQ ID NO: 3541
  Description of Unknown: uncultivated organism sequence
  Category: MG13 effectors repeat
  Description: MG13-4 effector repeat

SEQ ID NO: 3544 - DNA, 36 bp, Unknown; identical to SEQ ID NO: 3541
  Description of Unknown: uncultivated organism sequence
  Category: MG13 effectors repeat
  Description: MG13-4 effector repeat

SEQ ID NO: 3545 - DNA, 36 bp, Unknown
  Description of Unknown: uncultivated organism sequence
  Category: MG13 effectors repeat
  Description: MG13-6 effector repeat
gtctatagatataaagtaatttctactgttgtagat

SEQ ID NO: 3546 - DNA, 36 bp, Unknown
  Description of Unknown: uncultivated organism sequence
  Category: MG13 effectors repeat
  Description: MG13-7 effector repeat
gcctataagggccattaaatttctactgttgtagat

SEQ ID NO: 3547 - DNA, 36 bp, Unknown; identical to SEQ ID NO: 3546
  Description of Unknown: uncultivated organism sequence
  Category: MG13 effectors repeat
  Description: MG13-7 effector repeat

SEQ ID NO: 3548 - DNA, 36 bp, Unknown; identical to SEQ ID NO: 3546
  Description of Unknown: uncultivated organism sequence
  Category: MG13 effectors repeat
  Description: MG13-7 effector repeat

SEQ ID NO: 3549 - DNA, 36 bp, Unknown; identical to SEQ ID NO: 3546
  Description of Unknown: uncultivated organism sequence
  Category: MG13 effectors repeat
  Description: MG13-7 effector repeat

SEQ ID NO: 3550 - DNA, 36 bp, Unknown
  Description of Unknown: uncultivated organism sequence
  Category: MG13 effectors repeat
  Description: MG13-8 effector repeat
gtctgtaagactaatataatttctactattgtagat

SEQ ID NO: 3551 - DNA, 45 bp, Unknown
  Description of Unknown: uncultivated organism sequence
  Category: MG19 Guide RNA
  Description: MG19-2 dual guide RNA1
  modified_base (26)..(45): a, c, t, g, unknown or other
caccgaaagttagggacaaaaaggcnnnnnnnnnnnnnnnnnnnn

SEQ ID NO: 3552 - DNA, 96 bp, Unknown
  Description of Unknown: uncultivated organism sequence
  Category: MG19 Guide RNA
  Description: MG19-2 dual guide RNA2
gggtccctaacccaatgcgctcaagcggttttccctcttgataataatcaagagattgccttttcgacttttagtcgttactgcttgagcgcgcaa

SEQ ID NO: 3553 - DNA, 45 bp, Unknown
  Description of Unknown: uncultivated organism sequence
  Category: MG19 Guide RNA
  Description: MG19-3 dual guide RNA1
  modified_base (26)..(45): a, c, t, g, unknown or other
catcgaaagttagggactaaaaggcnnnnnnnnnnnnnnnnnnnn

SEQ ID NO: 3554 - DNA, 79 bp, Unknown
  Description of Unknown: uncultivated organism sequence
  Category: MG19 Guide RNA
  Description: MG19-3 dual guide RNA2
gagttcctaactcaagcgcctttgcgctttcccgttaacgaaagttaacgatgccttttagtgcagaggcgcaattttt

SEQ ID NO: 3555 - DNA, 45 bp, Unknown
  Description of Unknown: uncultivated organism sequence
  Category: MG19 Guide RNA
  Description: MG19-4 dual guide RNA1
  modified_base (26)..(45): a, c, t, g, unknown or other
catcgaaagttaggaaccaaaaggcnnnnnnnnnnnnnnnnnnnn

SEQ ID NO: 3556 - DNA, 101 bp, Unknown
  Description of Unknown: uncultivated organism sequence
  Category: MG19 Guide RNA
  Description: MG19-4 dual guide RNA2
gggttcctaaccttagcgctcttgcgctttccccaaccgaaaggttggttgcctttccctttttgggttcccaaaaggaacagtgcaagggcgcgcaattt

SEQ ID NO: 3557 - DNA, 45 bp, Unknown
  Description of Unknown: uncultivated organism sequence
  Category: MG19 Guide RNA
  Description: MG19-5 dual guide RNA1
  modified_base (26)..(45): a, c, t, g, unknown or other
catcgaatattaggaaccaaaaggcnnnnnnnnnnnnnnnnnnnn

SEQ ID NO: 3558 - DNA, 81 bp, Unknown
  Description of Unknown: uncultivated organism sequence
  Category: MG19 Guide RNA
  Description: MG19-5 dual guide RNA1
gggttcctaatatctatgcgcccttgcgctttccacttcataataaaatgaagtttgccttgtagtgcaagggcgcttttt

SEQ ID NO: 3559 - DNA, 127 bp, Unknown
  Description of Unknown: uncultivated organism sequence
  Category: MG20 Guide RNA
  Description: MG20-1 sgRNA
  modified_base (108)..(127): a, c, t, g, unknown or other
atcgtgcttttagtattttctttgagcactcgaaacagaaaggaaaacccaactgtttcacgaatctttgacaacttggaagaaattctaagaaggattcatcaaagnnnnnnnnnnnnnnnnnnnn

SEQ ID NO: 3560 - DNA, 36 bp, Unknown
  Description of Unknown: uncultivated organism sequence
  Category: MG26 effectors repeat
  Description: MG26-1 effector repeat
ctcgaaaaccaatatcgaatttctacttttgtagat

SEQ ID NO: 3561 - DNA, 36 bp, Unknown
  Description of Unknown: uncultivated organism sequence
  Category: MG26 effectors repeat
  Description: MG26-5 effector repeat
atttaaacataatatctaatctctacttttgtagat

SEQ ID NO: 3562 - DNA, 36 bp, Unknown; identical to SEQ ID NO: 3561
  Description of Unknown: uncultivated organism sequence
  Category: MG26 effectors repeat
  Description: MG26-5 effector repeat

SEQ ID NO: 3563 - DNA, 36 bp, Unknown; identical to SEQ ID NO: 3561
  Description of Unknown: uncultivated organism sequence
  Category: MG26 effectors repeat
  Description: MG26-5 effector repeat

SEQ ID NO: 3564 - DNA, 36 bp, Unknown; identical to SEQ ID NO: 3561
  Description of Unknown: uncultivated organism sequence
  Category: MG26 effectors repeat
  Description: MG26-5 effector repeat

SEQ ID NO: 3565 - DNA, 36 bp, Unknown
  Description of Unknown: uncultivated organism sequence
  Category: MG26 effectors repeat
  Description: MG26-12 effector repeat
ctctaaacctcatataaaatttctacttttgtagat

SEQ ID NO: 3566 - DNA, 37 bp, Unknown
  Description of Unknown: uncultivated organism sequence
  Category: MG26 effectors repeat
  Description: MG26-14 effector repeat
agtttaaacataatattaaatttctactttggtagat

SEQ ID NO: 3567 - DNA, 37 bp, Unknown; identical to SEQ ID NO: 3566
  Description of Unknown: uncultivated organism sequence
  Category: MG26 effectors repeat
  Description: MG26-14 effector repeat

SEQ ID NO: 3568 - DNA, 37 bp, Unknown; identical to SEQ ID NO: 3566
  Description of Unknown: uncultivated organism sequence
  Category: MG26 effectors repeat
  Description: MG26-14 effector repeat

SEQ ID NO: 3569 - DNA, 37 bp, Unknown; identical to SEQ ID NO: 3566
  Description of Unknown: uncultivated organism sequence
  Category: MG26 effectors repeat
  Description: MG26-14 effector repeat

SEQ ID NO: 3570 - DNA, 37 bp, Unknown; identical to SEQ ID NO: 3566
  Description of Unknown: uncultivated organism sequence
  Category: MG26 effectors repeat
  Description: MG26-14 effector repeat

SEQ ID NO: 3571 - DNA, 36 bp, Unknown
  Description of Unknown: uncultivated organism sequence
  Category: MG26 effectors repeat
  Description: MG26-16 effector repeat
ctctaaaacccccatctgatttctacttttgtagat

SEQ ID NO: 3572 - DNA, 36 bp, Unknown; identical to SEQ ID NO: 3571
  Description of Unknown: uncultivated organism sequence
  Category: MG26 effectors repeat
  Description: MG26-16 effector repeat

SEQ ID NO: 3573 - DNA, 36 bp, Unknown
  Description of Unknown: uncultivated organism sequence
  Category: MG28 effectors repeat
  Description: MG28-1 effector repeat
gtctataaagacaattaaatttctactatgtagatc

SEQ ID NO: 3574 - DNA, 36 bp, Unknown; identical to SEQ ID NO: 3573
  Description of Unknown: uncultivated organism sequence
  Category: MG28 effectors repeat
  Description: MG28-1 effector repeat

SEQ ID NO: 3575 - DNA, 36 bp, Unknown
  Description of Unknown: uncultivated organism sequence
  Category: MG28 effectors repeat
  Description: MG28-5 effector repeat
ggtgttagaccatacaaaatttctactattgtagat

SEQ ID NO: 3576 - DNA, 36 bp, Unknown
  Description of Unknown: uncultivated organism sequence
  Category: MG28 effectors repeat
  Description: MG28-7 effector repeat
ggctataatgcctatataatttctactattgtagat

SEQ ID NO: 3577 - DNA, 36 bp, Unknown
  Description of Unknown: uncultivated organism sequence
  Category: MG28 effectors repeat
  Description: MG28-8 effector repeat
ggctataatgcctatataatttctactattgtagac

SEQ ID NO: 3578 - DNA, 36 bp, Unknown; identical to SEQ ID NO: 3577
  Description of Unknown: uncultivated organism sequence
  Category: MG28 effectors repeat
  Description: MG28-8 effector repeat

SEQ ID NO: 3579 - DNA, 26 bp, Unknown
  Description of Unknown: uncultivated organism sequence
  Category: MG28 effectors repeat
  Description: MG28-10 effector repeat
catataaaatttctactattgtagat

SEQ ID NO: 3580 - DNA, 26 bp, Unknown
  Description of Unknown: uncultivated organism sequence
  Category: MG28 effectors repeat
  Description: MG28-10 effector repeat
catataaaatttctactattgtagat

SEQ ID NO: 3581 - DNA, 26 bp, Unknown
  Description of Unknown: uncultivated organism sequence
  Category: MG28 effectors repeat
  Description: MG28-10 effector repeat
catataaaatttctactattgtagat

SEQ ID NO: 3582 - DNA, 26 bp, Unknown
  Description of Unknown: uncultivated organism sequence
  Category: MG28 effectors repeat
  Description: MG28-10 effector repeat
catataaaatttctactattgtagat

SEQ ID NO: 3583 - DNA, 26 bp, Unknown
  Description of Unknown: uncultivated organism sequence
  Category: MG28 effectors repeat
  Description: MG28-10 effector repeat
catataaaatttctactattgtagat

SEQ ID NO: 3584 - DNA, 26 bp, Unknown
  Description of Unknown: uncultivated organism sequence
  Category: MG28 effectors repeat
  Description: MG28-11 effector repeat
catataaaatttctactattgtagat

SEQ ID NO: 3585 - DNA, 26 bp, Unknown
  Description of Unknown: uncultivated organism sequence
  Category: MG28 effectors repeat
  Description: MG28-11 effector repeat
catataaaatttctactattgtagat

SEQ ID NO: 3586 - DNA, 26 bp, Unknown
  Description of Unknown: uncultivated organism sequence
  Category: MG28 effectors repeat
  Description: MG28-11 effector repeat
catataaaatttctactattgtagat

SEQ ID NO: 3587 - DNA, 26 bp, Unknown
  Description of Unknown: uncultivated organism sequence
  Category: MG28 effectors repeat
  Description: MG28-11 effector repeat
catataaaatttctactattgtagat

SEQ ID NO: 3588 - DNA, 26 bp, Unknown
  Description of Unknown: uncultivated organism sequence
  Category: MG28 effectors repeat
  Description: MG28-11 effector repeat
catataaaatttctactattgtagat

SEQ ID NO: 3589 - DNA, 36 bp, Unknown
  Description of Unknown: uncultivated organism sequence
  Category: MG28 effectors repeat
  Description: MG28-12 effector repeat
gatgtaaaactacacataatttctactattgtagat

SEQ ID NO: 3590 - DNA, 36 bp, Unknown; identical to SEQ ID NO: 3589
  Description of Unknown: uncultivated organism sequence
  Category: MG28 effectors repeat
  Description: MG28-12 effector repeat

SEQ ID NO: 3591 - DNA, 36 bp, Unknown; identical to SEQ ID NO: 3589
  Description of Unknown: uncultivated organism sequence
  Category: MG28 effectors repeat
  Description: MG28-12 effector repeat

SEQ ID NO: 3592 - DNA, 36 bp, Unknown; identical to SEQ ID NO: 3589
  Description of Unknown: uncultivated organism sequence
  Category: MG28 effectors repeat
  Description: MG28-12 effector repeat

SEQ ID NO: 3593 - DNA, 36 bp, Unknown
  Description of Unknown: uncultivated organism sequence
  Category: MG28 effectors repeat
  Description: MG28-13 effector repeat
ggctataactcctcaataatttctactatcgtagat

SEQ ID NO: 3594 - DNA, 36 bp, Unknown; identical to SEQ ID NO: 3593
  Description of Unknown: uncultivated organism sequence
  Category: MG28 effectors repeat
  Description: MG28-13 effector repeat

SEQ ID NO: 3595 - DNA, 36 bp, Unknown
  Description of Unknown: uncultivated organism sequence
  Category: MG28 effectors repeat
  Description: MG28-14 effector repeat
ggctataactcctcaataatttctactattgtagat

SEQ ID NO: 3596 - DNA, 36 bp, Unknown
  Description of Unknown: uncultivated organism sequence
  Category: MG28 effectors repeat
  Description: MG28-17 effector repeat
gtctaacagacatttataatttctactattgtagat

SEQ ID NO: 3597 - DNA, 36 bp, Unknown
  Description of Unknown: uncultivated organism sequence
  Category: MG28 effectors repeat
  Description: MG28-19 effector repeat
ggctataagccaaacaaatttctactaagtgtagat

SEQ ID NO: 3598 - DNA, 36 bp, Unknown
  Description of Unknown: uncultivated organism sequence
  Category: MG28 effectors repeat
  Description: MG28-20 effector repeat
ggtgtaaaagcatacaaaatatctactattgtagat

SEQ ID NO: 3599 - DNA, 36 bp, Unknown; identical to SEQ ID NO: 3598
  Description of Unknown: uncultivated organism sequence
  Category: MG28 effectors repeat
  Description: MG28-20 effector repeat

SEQ ID NO: 3600 - DNA, 36 bp, Unknown
  Description of Unknown: uncultivated organism sequence
  Category: MG28 effectors repeat
  Description: MG28-22 effector repeat
ggctataaaccaaacaaatttctactaaatgtagat

SEQ ID NO: 3601 - DNA, 36 bp, Unknown; identical to SEQ ID NO: 3600
  Description of Unknown: uncultivated organism sequence
  Category: MG28 effectors repeat
  Description: MG28-22 effector repeat

SEQ ID NO: 3602 - DNA, 36 bp, Unknown; identical to SEQ ID NO: 3600
  Description of Unknown: uncultivated organism sequence
  Category: MG28 effectors repeat
  Description: MG28-22 effector repeat

SEQ ID NO: 3603 - DNA, 36 bp, Unknown
  Description of Unknown: uncultivated organism sequence
  Category: MG28 effectors repeat
  Description: MG28-23 effector repeat
cgtgtttagatatacagaatttctactattgtagat

SEQ ID NO: 3604 - DNA, 36 bp, Unknown
  Description of Unknown: uncultivated organism sequence
  Category: MG28 effectors repeat
  Description: MG28-24 effector repeat
gtctatagaacccttttaatttctactattgtagat

SEQ ID NO: 3605 - DNA, 28 bp, Unknown
  Description of Unknown: uncultivated organism sequence
  Category: MG28 effectors repeat
  Description: MG28-25 effector repeat
ataagatttaatatctactattgtagat

SEQ ID NO: 3606 - DNA, 28 bp, Unknown
  Description of Unknown: uncultivated organism sequence
  Category: MG28 effectors repeat
  Description: MG28-25 effector repeat
ataagatttaatatctactattgtagat

SEQ ID NO: 3607 - DNA, 28 bp, Unknown
  Description of Unknown: uncultivated organism sequence
  Category: MG28 effectors repeat
  Description: MG28-25 effector repeat
ataagatttaatatctactattgtagat

SEQ ID NO: 3608 - RNA, 43 nt, Artificial Sequence
  Description of Artificial Sequence: Synthetic oligonucleotide
  Category: MG28 effectors, MG30 active effectors crRNA sequence
  Description: MG28-1, MG30-1 crRNA sequence
  modified_base (20)..(43): a, c, u, g, unknown or other
aauuucuacuauuguagaunnnnnnnnnnnnnnnnnnnnnnnn

SEQ ID NO: 3609 - RNA, 44 nt, Unknown
  Description of Unknown: MG28, MG29, MG30, MG31 crRNA sequence
  Category: MG28, MG29, MG30, MG31 crRNA sequence
  Description: MG28, MG29, MG30, MG31 crRNA sequence example 8
  modified_base (21)..(44): a, c, u, g, unknown or other
uaauuucuacuguuguagaunnnnnnnnnnnnnnnnnnnnnnnn

SEQ ID NO: 3610 - DNA, 36 bp, Unknown
  Description of Unknown: uncultivated organism sequence
  Category: MG29 effectors repeat
  Description: MG29-1 effector repeat
gtctaagaccttacttaaatttctactgttgtagat

SEQ ID NO: 3611 - DNA, 36 bp, Unknown
  Description of Unknown: uncultivated organism sequence
  Category: MG29 effectors repeat
  Description: MG29-7 effector repeat
gtctaagaccgaccttaaatttctactgttgtagat

SEQ ID NO: 3612 - DNA, 43 bp, Unknown
  Description of Unknown: uncultivated organism sequence
  Category: MG29 Guide RNA
  Description: MG29-5 sgRNA
  modified_base (20)..(43): a, c, t, g, unknown or other
  misc_feature (20)..(43): This region may encompass 20 or 24 nucleotides
aatttctacagttgtagatnnnnnnnnnnnnnnnnnnnnnnnn

SEQ ID NO: 3613 - DNA, 36 bp, Unknown
  Description of Unknown: uncultivated organism sequence
  Category: MG30 effectors repeat
  Description: MG30-1 effector repeat
ctctagggctacccttaaatttctactattgtagat

SEQ ID NO: 3614 - DNA, 36 bp, Unknown; identical to SEQ ID NO: 3613
  Description of Unknown: uncultivated organism sequence
  Category: MG30 effectors repeat
  Description: MG30-1 effector repeat

SEQ ID NO: 3615 - DNA, 36 bp, Unknown; identical to SEQ ID NO: 3613
  Description of Unknown: uncultivated organism sequence
  Category: MG30 effectors repeat
  Description: MG30-1 effector repeat

SEQ ID NO: 3616 - DNA, 36 bp, Unknown
  Description of Unknown: uncultivated organism sequence
  Category: MG31 effectors repeat
  Description: MG31-1 effector repeat
gtttaagacaaatacaaaatttctactgttgtagat

SEQ ID NO: 3617 - DNA, 29 bp, Unknown
  Description of Unknown: uncultivated organism sequence
  Category: MG31 effectors repeat
  Description: MG31-5 effector repeat
actgatatagaatttctactgttgtagat

SEQ ID NO: 3618 - DNA, 29 bp, Unknown
  Description of Unknown: uncultivated organism sequence
  Category: MG31 effectors repeat
  Description: MG31-5 effector repeat
actgatatagaatttctactgttgtagat

SEQ ID NO: 3619 - DNA, 29 bp, Unknown
  Description of Unknown: uncultivated organism sequence
  Category: MG31 effectors repeat
  Description: MG31-5 effector repeat
actgatatagaatttctactgttgtagat

SEQ ID NO: 3620 - DNA, 36 bp, Unknown
  Description of Unknown: uncultivated organism sequence
  Category: MG31 effectors repeat
  Description: MG31-8 effector repeat
cgttaagacaaatacaaaatttctactgtcgtagat

SEQ ID NO: 3621 - DNA, 36 bp, Unknown; identical to SEQ ID NO: 3620
  Description of Unknown: uncultivated organism sequence
  Category: MG31 effectors repeat
  Description: MG31-8 effector repeat

SEQ ID NO: 3622 - DNA, 36 bp, Unknown; identical to SEQ ID NO: 3620
  Description of Unknown: uncultivated organism sequence
  Category: MG31 effectors repeat
  Description: MG31-8 effector repeat

SEQ ID NO: 3623 - DNA, 36 bp, Unknown
  Description of Unknown: uncultivated organism sequence
  Category: MG31 effectors repeat
  Description: MG31-9 effector repeat
gtttcaaagtgaactaaaatttctactgttgtagat

SEQ ID NO: 3624 - DNA, 36 bp, Unknown
  Description of Unknown: uncultivated organism sequence
  Category: MG31 effectors repeat
  Description: MG31-10 effector repeat
gtttgaacttcatactaaatttctactgttgtagat

SEQ ID NO: 3625 - DNA, 20 bp, Unknown
  Description of Unknown: uncultivated organism sequence
  Category: MG31 effectors repeat
  Description: MG31-11 effector repeat
gaatttctactgttgtagat

SEQ ID NO: 3626 - DNA, 20 bp, Unknown
  Description of Unknown: uncultivated organism sequence
  Category: MG31 effectors repeat
  Description: MG31-11 effector repeat
gaatttctactgttgtagat

SEQ ID NO: 3627 - DNA, 36 bp, Unknown
  Description of Unknown: uncultivated organism sequence
  Category: MG31 effectors repeat
  Description: MG31-16 effector repeat
gtttcaaactgaataagaatttctactgttgtagat

SEQ ID NO: 3628 - DNA, 36 bp, Unknown
  Description of Unknown: uncultivated organism sequence
  Category: MG31 effectors repeat
  Description: MG31-17 effector repeat
gtttagaacccaaataaaatttctactgttgtagat

SEQ ID NO: 3629 - DNA, 36 bp, Unknown; identical to SEQ ID NO: 3628
  Description of Unknown: uncultivated organism sequence
  Category: MG31 effectors repeat
  Description: MG31-18 effector repeat

SEQ ID NO: 3630 - DNA, 36 bp, Unknown; identical to SEQ ID NO: 3628
  Description of Unknown: uncultivated organism sequence
  Category: MG31 effectors repeat
  Description: MG31-18 effector repeat

SEQ ID NO: 3631 - DNA, 36 bp, Unknown; identical to SEQ ID NO: 3628
  Description of Unknown: uncultivated organism sequence
  Category: MG31 effectors repeat
  Description: MG31-19 effector repeat

SEQ ID NO: 3632 - DNA, 36 bp, Unknown; identical to SEQ ID NO: 3628
  Description of Unknown: uncultivated organism sequence
  Category: MG31 effectors repeat
  Description: MG31-17, MG31-18, MG31-19 effectors repeat

SEQ ID NO: 3633 - DNA, 36 bp, Unknown
  Description of Unknown: uncultivated organism sequence
  Category: MG32 effectors repeat
  Description: MG32-1 effector repeat
ctttaagagactccttcaatttctactgttgtagat

SEQ ID NO: 3634 - DNA, 36 bp, Unknown; identical to SEQ ID NO: 3633
  Description of Unknown: uncultivated organism sequence
  Category: MG32 effectors repeat
  Description: MG32-1 effector repeat

SEQ ID NO: 3635 - RNA, 36 nt, Artificial Sequence
  Description of Artificial Sequence: Synthetic oligonucleotide
  Category: MG37 effectors repeat
  Description: MG37-1 repeat
ggcgcgcuggccagcgcgcucaugaucgacugacac

SEQ ID NO: 3636 - RNA, 115 nt, Artificial Sequence
  Description of Artificial Sequence: Synthetic polynucleotide
  Category: MG37 sgRNA1
  Description: MG37-1 sgRNA1
  modified_base (92)..(115): a, c, u, g, unknown or other
ucgccuaaagggcgaaaugaucugcguucagugucgucgccuucaaugugcgcaucaccgcagaggucgaucagaaaugaucgacugacacnnnnnnnnnnnnnnnnnnnnnnnn

SEQ ID NO: 3637 - RNA, 93 nt, Artificial Sequence
  Description of Artificial Sequence: Synthetic oligonucleotide
  Category: MG37 sgRNA2
  Description: MG37-1 sgRNA2
  modified_base (70)..(93): a, c, u, g, unknown or other
ucgccuaaagggcgaaaugaucugcguucagugucgucgccuucaaugugcgcaucaccgcagagacacnnnnnnnnnnnnnnnnnnnnnnnn

SEQ ID NO: 3638 - RNA, 73 nt, Artificial Sequence
  Description of Artificial Sequence: Synthetic oligonucleotide
  Category: MG37 tracrRNA
  Description: MG37-1 tracrRNA
ucgccuaaagggcgaaaugaucugcguucagugucgucgccuucaaugugcgcaucaccgcagaggucgauca

SEQ ID NO: 3639 - RNA, 36 nt, Artificial Sequence
  Description of Artificial Sequence: Synthetic oligonucleotide
  Category: MG37 repeat
  Description: MG37-2 repeat
ccagaagcgagcguggcauugcgaggugacggacac

SEQ ID NO: 3640 - RNA, 111 nt, Artificial Sequence
  Description of Artificial Sequence: Synthetic polynucleotide
  Category: MG37 sgRNA1
  Description: MG37-2 sgRNA1
  modified_base (88)..(111): a, c, u, g, unknown or other
uuccucgacaggaggaaacaacgcugcggaacgugucguccccuuuaaugggcuugguaccgcaggucaccgaaaggugacggacacnnnnnnnnnnnnnnnnnnnnnnnn

SEQ ID NO: 3641 - RNA, 95 nt, Artificial Sequence
  Description of Artificial Sequence: Synthetic oligonucleotide
  Category: MG37 sgRNA2
  Description: MG37-2 sgRNA2
  modified_base (72)..(95): a, c, u, g, unknown or other
uuccucgacaggaggaaacaacgcugcggaacgugucguccccuuuaaugggcuugguaccgcagggacacnnnnnnnnnnnnnnnnnnnnnnnn

SEQ ID NO: 3642 - RNA, 71 nt, Artificial Sequence
  Description of Artificial Sequence: Synthetic oligonucleotide
  Category: MG37 tracrRNA
  Description: MG37-2 tracrRNA
uuccucgacaggaggaaacaacgcugcggaacgugucguccccuuuaaugggcuugguaccgcaggucacc

SEQ ID NO: 3643 - RNA, 37 nt, Artificial Sequence
  Description of Artificial Sequence: Synthetic oligonucleotide
  Category: MG37 repeat
  Description: MG37-3 repeat
ccucgccgacggugaaaggaaccagaucugcugacac

SEQ ID NO: 3644 - RNA, 116 nt, Artificial Sequence
  Description of Artificial Sequence: Synthetic polynucleotide
  Category: MG37 sgRNA1
  Description: MG37-3 sgRNA1
  modified_base (93)..(116): a, c, u, g, unknown or other
aauaaaaugguccuacaggggcugaaaucgcgcgggugugucaucggcuucaaugccuuuagcaccgcgagcagaugaaaaucugcugacacnnnnnnnnnnnnnnnnnnnnnnnn

SEQ ID NO: 3645 - RNA, 98 nt, Artificial Sequence
  Description of Artificial Sequence: Synthetic oligonucleotide
  Category: MG37 sgRNA2
  Description: MG37-3 sgRNA2
  modified_base (75)..(98): a, c, u, g, unknown or other
aauaaaaugguccuacaggggcugaaaucgcgcgggugugucaucggcuucaaugccuuuagcaccgcggacacnnnnnnnnnnnnnnnnnnnnnnnn

SEQ ID NO: 3646 - RNA, 76 nt, Artificial Sequence
  Description of Artificial Sequence: Synthetic oligonucleotide
  Category: MG37 tracrRNA
  Description: MG37-3 tracrRNA
aauaaaaugguccuacaggggcugaaaucgcgcgggugugucaucggcuucaaugccuuuagcaccgcgagcagau

SEQ ID NO: 3647 - RNA, 36 nt, Artificial Sequence
  Description of Artificial Sequence: Synthetic oligonucleotide
  Category: MG37 repeat
  Description: MG37-4 repeat
ggcggcgaauucgccggcaucucgaucgaccgacac

SEQ ID NO: 3648 - RNA, 131 nt, Artificial Sequence
  Description of Artificial Sequence: Synthetic polynucleotide
  Category: MG37 sgRNA1
  Description: MG37-4 sgRNA1
  modified_base (108)..(131): a, c, u, g, unknown or other
uauauugaaagcaauccgcuacaggcggagggaacuccgugaacgugucuuccccuucgaugggcuuggcacacggggucaaucgaggaaacucgaucgaccgacacnnnnnnnnnnnnnnnnnnnnnnnn

SEQ ID NO: 3649 - RNA, 105 nt, Artificial Sequence
  Description of Artificial Sequence: Synthetic polynucleotide
  Category: MG37 sgRNA2
  Description: MG37-4 sgRNA2
  modified_base (82)..(105): a, c, u, g, unknown or other
uauauugaaagcaauccgcuacaggcggagggaacuccgugaacgugucuuccccuucgaugggcuuggcacacgggacacnnnnnnnnnnnnnnnnnnnnnnnn

SEQ ID NO: 3650 - RNA, 87 nt, Artificial Sequence
  Description of Artificial Sequence: Synthetic oligonucleotide
  Category: MG37 tracrRNA
  Description: MG37-4 tracrRNA
uauauugaaagcaauccgcuacaggcggagggaacuccgugaacgugucuuccccuucgaugggcuuggcacacggggucaaucgag

SEQ ID NO: 3651 - RNA, 36 nt, Artificial Sequence
  Description of Artificial Sequence: Synthetic oligonucleotide
  Category: MG37 repeat1
  Description: MG37-5 repeat1
guaucaccgguugaagcacaccucauugauggacac

SEQ ID NO: 3652 - RNA, 120 nt, Artificial Sequence
  Description of Artificial Sequence: Synthetic polynucleotide
  Category: MG37 sgRNA1
  Description: MG37-5 sgRNA1
  modified_base (97)..(120): a, c, u, g, unknown or other
uaauaagaagcuccuauagggaguguauuuuuuacggaaugugucuuccuauuaaauuaguuuagcaccguaacauuaaugaaaauugauggacacnnnnnnnnnnnnnnnnnnnnnnnn

SEQ ID NO: 3653 - RNA, 102 nt, Artificial Sequence
  Description of Artificial Sequence: Synthetic polynucleotide
  Category: MG37 sgRNA2
  Description: MG37-5 sgRNA2
  modified_base (79)..(102): a, c, u, g, unknown or other
uaauaagaagcuccuauagggaguguauuuuuuacggaaugugucuuccuauuaaauuaguuuagcaccguaagacacnnnnnnnnnnnnnnnnnnnnnnnn

SEQ ID NO: 3654 - RNA, 80 nt, Artificial Sequence
  Description of Artificial Sequence: Synthetic oligonucleotide
  Category: MG37 tracrRNA1
  Description: MG37-5 tracrRNA1
uaauaagaagcuccuauagggaguguauuuuuuacggaaugugucuuccuauuaaauuaguuuagcaccguaacauuaau

SEQ ID NO: 3655 - RNA, 36 nt, Artificial Sequence
  Description of Artificial Sequence: Synthetic oligonucleotide
  Category: MG37 repeat
  Description: MG37-6 repeat
gucgcaucgcuuccgagaaaccaacgcuguuggcac

SEQ ID NO: 3656 - RNA, 110 nt, Artificial Sequence
  Description of Artificial Sequence: Synthetic polynucleotide
  Category: MG37 sgRNA1
  Description: MG37-6 sgRNA1
  modified_base (87)..(110): a, c, u, g, unknown or other
aaggacgucgaaaucgaugucgcucugugguaugugccuccgucuuaaaugacuuuaagccacaggacagcgaaagcuguuggcacnnnnnnnnnnnnnnnnnnnnnnnn

SEQ ID NO: 3657 - RNA, 94 nt, Artificial Sequence
  Description of Artificial Sequence: Synthetic oligonucleotide
  Category: MG37 sgRNA2
  Description: MG37-6 sgRNA2
  modified_base (71)..(94): a, c, u, g, unknown or other
aaggacgucgaaaucgaugucgcucugugguaugugccuccgucuuaaaugacuuuaagccacagggcacnnnnnnnnnnnnnnnnnnnnnnnn

SEQ ID NO: 3658 - RNA, 71 nt, Artificial Sequence
  Description of Artificial Sequence: Synthetic oligonucleotide
  Category: MG37 tracrRNA
  Description: MG37-6 tracrRNA
aaggacgucgaaaucgaugucgcucugugguaugugccuccgucuuaaaugacuuuaagccacaggacagc

SEQ ID NO: 3659 - RNA, 36 nt, Artificial Sequence
  Description of Artificial Sequence: Synthetic oligonucleotide
  Category: MG37 repeat
  Description: MG37-7 repeat
ggagcaucgagcaacccgaacuucaucuacugacac

SEQ ID NO: 3660 - RNA, 126 nt, Artificial Sequence
  Description of Artificial Sequence: Synthetic polynucleotide
  Category: MG37 sgRNA1
  Description: MG37-7 sgRNA1
  modified_base (103)..(126): a, c, u, g, unknown or other
auuaucaauguauccuacagggguacggaauuacgcggcaugugucgucgccuucaauggccuuggcaccgcgugguagaaugagaaaucaucuacugacacnnnnnnnnnnnnnnnnnnnnnnnn

SEQ ID NO: 3661 - RNA, 104 nt, Artificial Sequence
  Description of Artificial Sequence: Synthetic polynucleotide
  Category: MG37 sgRNA2
  Description: MG37-7 sgRNA2
  modified_base (81)..(104): a, c, u, g, unknown or other
auuaucaauguauccuacagggguacggaauuacgcggcaugugucgucgccuucaauggccuuggcaccgcguggacacnnnnnnnnnnnnnnnnnnnnnnnn

SEQ ID NO: 3662 - RNA, 84 nt, Artificial Sequence
  Description of Artificial Sequence: Synthetic oligonucleotide
  Category: MG37 tracrRNA
  Description: MG37-7 tracrRNA
auuaucaauguauccuacagggguacggaauuacgcggcaugugucgucgccuucaauggccuuggcaccgcgugguagaauga

SEQ ID NO: 3663 - RNA, 37 nt, Artificial Sequence
  Description of Artificial Sequence: Synthetic oligonucleotide
  Category: MG53 repeat
  Description: MG53-1 repeat
cauaacgcccagaagaggaccugaucgcaccggacac

SEQ ID NO: 3664 - RNA, 205 nt, Artificial Sequence
  Description of Artificial Sequence: Synthetic polynucleotide
  Category: MG53 sgRNA1
  Description: MG53-1 sgRNA1
  modified_base (182)..(205): a, c, u, g, unknown or other
uucgggccuggguuccgucuauaggucgggacucacgcugagaaugugucucgccggaauguggcugcgggcgacccccgcaacugggcucggcgcgggcaaccgcgacgaggcuauggcgucucagcgggugcguucaguuucucuucugaaaagaagaggaccugaucgcaccggacacnnnnnnnnnnnnnnnnnnnnnnnn

SEQ ID NO: 3665 - RNA, 175 nt, Artificial Sequence
  Description of Artificial Sequence: Synthetic polynucleotide
  Category: MG53 sgRNA2
  Description: MG53-1 sgRNA2
  modified_base (152)..(175): a, c, u, g, unknown or other
uucgggccuggguuccgucuauaggucgggacucacgcugagaaugugucucgccggaauguggcugcgggcgacccccgcaacugggcucggcgcgggcaaccgcgacgaggcuauggcgucucagcgggugcggaaacgcaccggacacnnnnnnnnnnnnnnnnnnnnnnnn

SEQ ID NO: 3666 - RNA, 210 nt, Artificial Sequence
  Description of Artificial Sequence: Synthetic polynucleotide
  Category: MG53 sgRNA3
  Description: MG53-1 sgRNA3
  modified_base (187)..(210): a, c, u, g, unknown or other
uucggccgccguagguucauauucguacuguggccuucgggccuggguuccgucuauaggucgggacucacgcugagaaugugucucgccggaauguggcugcgggcgacccccgcaacugggcucggcgcgggcaaccgcgacgaggcuauggcgucucagcgggugcggaaacgcaccggacacnnnnnnnnnnnnnnnnnnnnnnnn

SEQ ID NO: 3667 - RNA, 240 nt, Artificial Sequence
  Description of Artificial Sequence: Synthetic polynucleotide
  Category: MG53 sgRNA4
  Description: MG53-1 sgRNA4
  modified_base (217)..(240): a, c, u, g, unknown or other
uucggccgccguagguucauauucguacuguggccuucgggccuggguuccgucuauaggucgggacucacgcugagaaugugucucgccggaauguggcugcgggcgacccccgcaacugggcucggcgcgggcaaccgcgacgaggcuauggcgucucagcgggugcguucaguuucucuucugaaaagaagaggaccugaucgcaccggacacnnnnnnnnnnnnnnnnnnnnnnnn

SEQ ID NO: 3668 - RNA, 150 nt, Artificial Sequence
  Description of Artificial Sequence: Synthetic polynucleotide
  Category: MG53 tracrRNA1
  Description: MG53-1 tracrRNA1
uucgggccuggguuccgucuauaggucgggacucacgcugagaaugugucucgccggaauguggcugcgggcgacccccgcaacugggcucggcgcgggcaaccgcgacgaggcuauggcgucucagcgggugcguucaguuucucuucu

SEQ ID NO: 3669 - RNA, 228 nt, Artificial Sequence
  Description of Artificial Sequence: Synthetic polynucleotide
  Category: MG53 tracrRNA2
  Description: MG53-1 tracrRNA2
gccacacgggcaauacggggcuuugcucgcagaccccuugacuuucggccgccguagguucauauucguacuguggccuucgggccuggguuccgucuauaggucgggacucacgcugagaaugugucucgccggaauguggcugcgggcgacccccgcaacugggcucggcgcgggcaaccgcgacgaggcuauggcgucucagcgggugcguucaguuucucuucu

SEQ ID NO: 3670 - RNA, 36 nt, Artificial Sequence
  Description of Artificial Sequence: Synthetic oligonucleotide
  Category: MG54 repeat
  Description: MG54-1 repeat
gccgcgucccccgacgcgacccugaucgauggacac

SEQ ID NO: 3671 - RNA, 172 nt, Artificial Sequence
  Description of Artificial Sequence: Synthetic polynucleotide
  Category: MG54 sgRNA1
  Description: MG54-1 sgRNA1
  modified_base (149)..(172): a, c, u, g, unknown or other
cgggcagccacgcagccgucguuccugagugucaacacgugcuggcccuaaggcgcucgcgccgauggggacccgacaacggcggggcgacccgcccgcggcggcacggacggcgacggcaucgaucaggaaacugaucgauggacacnnnnnnnnnnnnnnnnnnnnnnnn

SEQ ID NO: 3672 - RNA, 217 nt, Artificial Sequence
  Description of Artificial Sequence: Synthetic polynucleotide
  Category: MG54 sgRNA2
  Description: MG54-1 sgRNA2
  modified_base (194)..(217): a, c, u, g, unknown or other
gcaucggcggggucgcguccgcccgcccagcggcuauaggcaggccgggcagccacgcagccgucguuccugagugucaacacgugcuggcccuaaggcgcucgcgccgauggggacccgacaacggcggggcgacccgcccgcggcggcacggacggcgacggcaucgaucaggaaacugaucgauggacacnnnnnnnnnnnnnnnnnnnnnnnn

SEQ ID NO: 3673 - RNA, 145 nt, Artificial Sequence
  Description of Artificial Sequence: Synthetic polynucleotide
  Category: MG54 tracrRNA1
  Description: MG54-1 tracrRNA1
cgggcagccacgcagccgucguuccugagugucaacacgugcuggcccuaaggcgcucgcgccgauggggacccgacaacggcggggcgacccgcccgcggcggcacggacggcgacggcaucgaucagcuucgcgucggcccgg

SEQ ID NO: 3674 - RNA, 129 nt, Artificial Sequence
  Description of Artificial Sequence: Synthetic polynucleotide
  Category: MG54 tracrRNA2
  Description: MG54-1 tracrRNA2
cgggcagccacgcagccgucguuccugagugucaacacgugcuggcccuaaggcgcucgcgccgauggggacccgacaacggcggggcgacccgcccgcggcggcacggacggcgacggcaucgaucag

SEQ ID NO: 3675 - RNA, 108 nt, Artificial Sequence
  Description of Artificial Sequence: Synthetic polynucleotide
  Category: MG54 tracrRNA3
  Description: MG54-1 tracrRNA3
uuccugagugucaacacgugcuggcccuaaggcgcucgcgccgauggggacccgacaacggcggggcgacccgcccgcggcggcacggacggcgacggcaucgaucag

SEQ ID NO: 3676 - RNA, 215 nt, Artificial Sequence
  Description of Artificial Sequence: Synthetic polynucleotide
  Category: MG54 tracrRNA4
  Description: MG54-1 tracrRNA4
uuccgugguauacugcacucguggagcaucggcggggucgcguccgcccgcccagcggcuauaggcaggccgggcagccacgcagccgucguuccugagugucaacacgugcuggcccuaaggcgcucgcgccgauggggacccgacaacggcggggcgacccgcccgcggcggcacggacggcgacggcaucgaucagcuucgcgucggcccgg

SEQ ID NO: 3677 - skipped

SEQ ID NO: 3678 - RNA, 44 nt, Artificial Sequence
  Description of Artificial Sequence: Synthetic oligonucleotide
  Category: MG56 effectors crRNA
  Description: MG56-1, MG56-2 effectors crRNA
  modified_base (21)..(44): a, c, u, g, unknown or other
aaauuucuacuuuuguagaunnnnnnnnnnnnnnnnnnnnnnnn

SEQ ID NO: 3679 - DNA, 36 bp, Unknown
  Description of Unknown: uncultivated organism sequence
  Category: MG56 effectors repeat
  Description: MG56-1 effector repeat
ctcaaatagacctatcaaatttctacttttgtagat

SEQ ID NO: 3680 - DNA, 36 bp, Unknown; identical to SEQ ID NO: 3679
  Description of Unknown: uncultivated organism sequence
  Category: MG56 effectors repeat
  Description: MG56-1, MG60-8 effectors repeat

SEQ ID NO: 3681 - DNA, 36 bp, Unknown
  Description of Unknown: uncultivated organism sequence
  Category: MG57 effectors repeat
  Description: MG57-3 effector repeat
gtttgaatttcatactaaatttctactgttgtagat

SEQ ID NO: 3682 - DNA, 36 bp, Unknown
  Description of Unknown: uncultivated organism sequence
  Category: MG57 effectors repeat
  Description: MG57-7 effector repeat
ctctaaataacaaataaaatttctactattgtagat

SEQ ID NO: 3683 - DNA, 36 bp, Unknown; identical to SEQ ID NO: 3682
  Description of Unknown: uncultivated organism sequence
  Category: MG57 effectors repeat
  Description: MG57-7 effector repeat

SEQ ID NO: 3684 - DNA, 36 bp, Unknown; identical to SEQ ID NO: 3682
  Description of Unknown: uncultivated organism sequence
  Category: MG57 effectors repeat
  Description: MG57-7 effector repeat

SEQ ID NO: 3685 - DNA, 36 bp, Unknown; identical to SEQ ID NO: 3682
  Description of Unknown: uncultivated organism sequence
  Category: MG57 effectors repeat
  Description: MG57-7 effector repeat

SEQ ID NO: 3686 - DNA, 36 bp, Unknown
  Description of Unknown: uncultivated organism sequence
  Category: MG57 effectors repeat
  Description: MG57-13 effector repeat
gtctaaaaggcttagacaatttctactattgtagat

SEQ ID NO: 3687 - DNA, 36 bp, Unknown
  Description of Unknown: uncultivated organism sequence
  Category: MG57 effectors repeat
  Description: MG57-14 effector repeat
ggctacaagccatattaaatttctactattgtagat

SEQ ID NO: 3688 - DNA, 36 bp, Unknown; identical to SEQ ID NO: 3687
  Description of Unknown: uncultivated organism sequence
  Category: MG57 effectors repeat
  Description: MG57-14 effector repeat

SEQ ID NO: 3689 - DNA, 36 bp, Unknown; identical to SEQ ID NO: 3687
  Description of Unknown: uncultivated organism sequence
  Category: MG57 effectors repeat
  Description: MG57-14 effector repeat

SEQ ID NO: 3690 - DNA, 23 bp, Unknown
  Description of Unknown: uncultivated organism sequence
  Category: MG57 effectors repeat
  Description: MG57-15 effector repeat
acaaaatttctactattgtagat

SEQ ID NO: 3691 - DNA, 23 bp, Unknown
  Description of Unknown: uncultivated organism sequence
  Category: MG57 effectors repeat
  Description: MG57-15 effector repeat
acaaaatttctactattgtagat

SEQ ID NO: 3692 - DNA, 23 bp, Unknown
  Description of Unknown: uncultivated organism sequence
  Category: MG57 effectors repeat
  Description: MG57-15 effector repeat
acaaaatttctactattgtagat

SEQ ID NO: 3693 - DNA, 23 bp, Unknown
  Description of Unknown: uncultivated organism sequence
  Category: MG57 effectors repeat
  Description: MG57-15 effector repeat
acaaaatttctactattgtagat

SEQ ID NO: 3694 - DNA, 23 bp, Unknown
  Description of Unknown: uncultivated organism sequence
  Category: MG57 effectors repeat
  Description: MG57-15 effector repeat
acaaaatttctactattgtagat

SEQ ID NO: 3695 - DNA, 43 bp, Artificial Sequence
  Description of Artificial Sequence: Synthetic oligonucleotide
  Category: MG57 guide RNA
  Description: MG57-1 sgRNA
  modified_base (20)..(43): a, c, t, g, unknown or other
aatttctactatcgtagatnnnnnnnnnnnnnnnnnnnnnnnn

SEQ ID NO: 3696 - DNA, 44 bp, Artificial Sequence
  Description of Artificial Sequence: Synthetic oligonucleotide
  Category: MG57 guide RNA
  Description: MG57-2 sgRNA
  modified_base (21)..(44): a, c, t, g, unknown or other
aatttctactagtgtagattnnnnnnnnnnnnnnnnnnnnnnnn

SEQ ID NO: 3697 - DNA, 36 bp, Unknown
  Description of Unknown: uncultivated organism sequence
  Category: MG58 effectors repeat
  Description: MG58-1 effector repeat
gtttagaaattatataagatttctacttttgtagat

SEQ ID NO: 3698 - DNA, 36 bp, Unknown; identical to SEQ ID NO: 3697
  Description of Unknown: uncultivated organism sequence
  Category: MG58 effectors repeat
  Description: MG58-1, MG58-6, MG60-1 effectors repeat

SEQ ID NO: 3699 - DNA, 36 bp, Unknown
  Description of Unknown: uncultivated organism sequence
  Category: MG58 effectors repeat
  Description: MG58-2 effector repeat
atcaattactagtttccaatttctacttttgtagat

SEQ ID NO: 3700 - DNA, 36 bp, Unknown
  Description of Unknown: uncultivated organism sequence
  Category: MG58 effectors repeat
  Description: MG58-3 effector repeat
gtttagaacttatataagatttctacttttgtagat

SEQ ID NO: 3701 - DNA, 36 bp, Unknown; identical to SEQ ID NO: 3700
  Description of Unknown: uncultivated organism sequence
  Category: MG58 effectors repeat
  Description: MG58-3, MG58-7 effectors repeat

SEQ ID NO: 3702 - DNA, 36 bp, Unknown
  Description of Unknown: uncultivated organism sequence
  Category: MG58 effectors repeat
  Description: MG58-4 effector repeat
gtttagaagttatataagatttctacttttgtagat

SEQ ID NO: 3703 - DNA, 36 bp, Unknown; identical to SEQ ID NO: 3702
  Description of Unknown: uncultivated organism sequence
  Category: MG58 effectors repeat
  Description: MG58-4, MG58-11, MG60-7 effectors repeat

SEQ ID NO: 3704 - DNA, 36 bp, Unknown; identical to SEQ ID NO: 3697
  Description of Unknown: uncultivated organism sequence
  Category: MG58 effectors repeat
  Description: MG58-6 effector repeat

SEQ ID NO: 3705 - DNA, 36 bp, Unknown; identical to SEQ ID NO: 3700
  Description of Unknown: uncultivated organism sequence
  Category: MG58 effectors repeat
  Description: MG58-7 effector repeat

SEQ ID NO: 3706 - DNA, 36 bp, Unknown
  Description of Unknown: uncultivated organism sequence
  Category: MG58 effectors repeat
  Description: MG58-10 effector repeat
gtttagaagttatataagatttctacttctgtagat

SEQ ID NO: 3707 - DNA, 36 bp, Unknown; identical to SEQ ID NO: 3706
  Description of Unknown: uncultivated organism sequence
  Category: MG58 effectors repeat
  Description: MG58-10 effector repeat

SEQ ID NO: 3708 - DNA, 36 bp, Unknown; identical to SEQ ID NO: 3702
  Description of Unknown: uncultivated organism sequence
  Category: MG58 effectors repeat
  Description: MG58-11 effector repeat

SEQ ID NO: 3709 - DNA, 36 bp, Unknown
  Description of Unknown: uncultivated organism sequence
  Category: MG58 effectors repeat
  Description: MG58-12 effector repeat
gtttagaaactatataagatttctacttttgtagat

SEQ ID NO: 3710 - DNA, 36 bp, Unknown; identical to SEQ ID NO: 3709
  Description of Unknown: uncultivated organism sequence
  Category: MG58 effectors repeat
  Description: MG58-12, MG58-13 effectors repeat

SEQ ID NO: 3711 - DNA, 36 bp, Unknown; identical to SEQ ID NO: 3709
  Description of Unknown: uncultivated organism sequence
  Category: MG58 effectors repeat
  Description: MG58-13 effector repeat

SEQ ID NO: 3712 - DNA, 36 bp, Unknown
  Description of Unknown: uncultivated organism sequence
  Category: MG59 effectors repeat
  Description: MG59-1 effector repeat
gtcaaacactccgccacaatttctactgtcgtagat

SEQ ID NO: 3713 - DNA, 36 bp, Unknown; identical to SEQ ID NO: 3712
  Description of Unknown: uncultivated organism sequence
  Category: MG59 effectors repeat
  Description: MG59-1 effector repeat

SEQ ID NO: 3714 - DNA, 36 bp, Unknown; identical to SEQ ID NO: 3712
  Description of Unknown: uncultivated organism sequence
  Category: MG59 effectors repeat
  Description: MG59-1 effector repeat

SEQ ID NO: 3715 - DNA, 32 bp, Unknown
  Description of Unknown: uncultivated organism sequence
  Category: MG59 effectors repeat
  Description: MG59-2 effector repeat
agggcccctcataaatttctactgttgtagat

SEQ ID NO: 3716 - DNA, 32 bp, Unknown; identical to SEQ ID NO: 3715
  Description of Unknown: uncultivated organism sequence
  Category: MG59 effectors repeat
  Description: MG59-2 effector repeat

SEQ ID NO: 3717 - DNA, 36 bp, Unknown
  Description of Unknown: uncultivated organism sequence
  Category: MG59 effectors repeat
  Description: MG59-3 effector repeat
gtttccccacgtggttaaatttctacttttgtagat

SEQ ID NO: 3718 - DNA, 36 bp, Unknown; identical to SEQ ID NO: 3717
  Description of Unknown: uncultivated organism sequence
  Category: MG59 effectors repeat
  Description: MG59-3 effector repeat

SEQ ID NO: 3719 - DNA, 29 bp, Unknown
  Description of Unknown: uncultivated organism sequence
  Category: MG59 effectors repeat
  Description: MG59-4 effector repeat
cacgtggtttaatttctacttttgtagat

SEQ ID NO: 3720 - DNA, 20 bp, Unknown
  Description of Unknown: uncultivated organism sequence
  Category: MG59 effectors repeat
  Description: MG59-5 effector repeat
aaatctctactgtcgtagag

SEQ ID NO: 3721 - DNA, 20 bp, Unknown
  Description of Unknown: uncultivated organism sequence
  Category: MG59 effectors repeat
  Description: MG59-5 effector repeat
aaatctctactgtcgtagag

SEQ ID NO: 3722 - DNA, 20 bp, Unknown
  Description of Unknown: uncultivated organism sequence
  Category: MG59 effectors repeat
  Description: MG59-5 effector repeat
aaatctctactgtcgtagag

SEQ ID NO: 3723 - DNA, 19 bp, Unknown
  Description of Unknown: uncultivated organism sequence
  Category: MG59 effectors repeat
  Description: MG59-6 effector repeat
aatttctactgttgtagat

SEQ ID NO: 3724 - DNA, 36 bp, Unknown
  Description of Unknown: uncultivated organism sequence
  Category: MG59 effectors repeat
  Description: MG59-7 effector repeat
gttttgcaatcttccctaatttctactgttgtagat

SEQ ID NO: 3725 - DNA, 36 bp, Unknown; identical to SEQ ID NO: 3724
  Description of Unknown: uncultivated organism sequence
  Category: MG59 effectors repeat
  Description: MG59-7, MG59-9 effectors repeat

SEQ ID NO: 3726 - DNA, 36 bp, Unknown
  Description of Unknown: uncultivated organism sequence
  Category: MG59 effectors repeat
  Description: MG59-8 effector repeat
cttttgcaatcttccctaatttctactgttgtagat

SEQ ID NO: 3727 - DNA, 36 bp, Unknown; identical to SEQ ID NO: 3726
  Description of Unknown: uncultivated organism sequence
  Category: MG59 effectors repeat
  Description: MG59-8 effector repeat

SEQ ID NO: 3728 - DNA, 36 bp, Unknown; identical to SEQ ID NO: 3724
  Description of Unknown: uncultivated organism sequence
  Category: MG59 effectors repeat
  Description: MG59-9 effector repeat

SEQ ID NO: 3729 - DNA, 43 bp, Artificial Sequence
  Description of Artificial Sequence: Synthetic oligonucleotide
  Category: MG59 guide RNA
  Description: MG59-1 sgRNA
  modified_base (20)..(43): a, c, t, g, unknown or other
aatttctactgtcgtagatnnnnnnnnnnnnnnnnnnnnnnnn

SEQ ID NO: 3730 - DNA, 43 bp, Artificial Sequence
  Description of Artificial Sequence: Synthetic oligonucleotide
  Category: MG59 guide RNA
  Description: MG59-2 sgRNA
  modified_base (20)..(43): a, c, t, g, unknown or other
aatttctactgttgtagatnnnnnnnnnnnnnnnnnnnnnnnn

SEQ ID NO: 3731 - DNA, 36 bp, Unknown
  Description of Unknown: uncultivated organism sequence
  Category: MG60 effectors repeat
  Description: MG60-3 effector repeat
gtttaaacatagtatctaatttctactttggtagat

SEQ ID NO: 3732 - DNA, 36 bp, Unknown
  Description of Unknown: uncultivated organism sequence
  Category: MG60 effectors repeat
  Description: MG60-6 effector repeat
gttgaaagaataaataaagtacctgctgttgcaggc

SEQ ID NO: 3733 - DNA, 36 bp, Unknown; identical to SEQ ID NO: 3702
  Description of Unknown: uncultivated organism sequence
  Category: MG60 effectors repeat
  Description: MG60-7 effector repeat

SEQ ID NO: 3734 - RNA, 44 nt, Artificial Sequence
  Description of Artificial Sequence: Synthetic oligonucleotide
  Category: MG61 effectors crRNA
  Description: MG61-1 effector crRNA
  modified_base (21)..(44): a, c, u, g, unknown or other
aaauaccugcuauugcaggcnnnnnnnnnnnnnnnnnnnnnnnn

SEQ ID NO: 3735 - RNA, 43 nt, Artificial Sequence
  Description of Artificial Sequence: Synthetic oligonucleotide
  Category: MG61 effectors crRNA
  Description: MG61-2 effector crRNA
  modified_base (20)..(43): a, c, u, g, unknown or other
aaaugccugcuggugcaggnnnnnnnnnnnnnnnnnnnnnnnn

SEQ ID NO: 3736 - DNA, 36 bp, Unknown
  Description of Unknown: uncultivated organism sequence
  Category: MG61 effectors repeat
  Description: MG61-1 effector repeat
ggtatataccatcaataaatacctgctattgcaggc

SEQ ID NO: 3737 - DNA, 36 bp, Unknown; identical to SEQ ID NO: 3736
  Description of Unknown: uncultivated organism sequence
  Category: MG61 effectors repeat
  Description: MG61-1 effector repeat

SEQ ID NO: 3738 - DNA, 36 bp, Unknown; identical to SEQ ID NO: 3736
  Description of Unknown: uncultivated organism sequence
  Category: MG61 effectors repeat
  Description: MG61-1 effector repeat

SEQ ID NO: 3739 - DNA, 36 bp, Unknown; identical to SEQ ID NO: 3736
  Description of Unknown: uncultivated organism sequence
  Category: MG61 effectors repeat
  Description: MG61-1 effector repeat

SEQ ID NO: 3740 - DNA, 35 bp, Unknown
  Description of Unknown: uncultivated organism sequence
  Category: MG61 effectors repeat
  Description: MG61-2 effector repeat
attataaggataatagaaatacctgctggtgcagg

SEQ ID NO: 3741 - DNA, 35 bp, Unknown; identical to SEQ ID NO: 3740
  Description of Unknown: uncultivated organism sequence
  Category: MG61 effectors repeat
  Description: MG61-2 effector repeat

SEQ ID NO: 3742 - DNA, 35 bp, Unknown; identical to SEQ ID NO: 3740
  Description of Unknown: uncultivated organism sequence
  Category: MG61 effectors repeat
  Description: MG61-2 effector repeat

SEQ ID NO: 3743 - DNA, 35 bp, Unknown; identical to SEQ ID NO: 3740
  Description of Unknown: uncultivated organism sequence
  Category: MG61 effectors repeat
  Description: MG61-2 effector repeat

SEQ ID NO: 3744 - DNA, 35 bp, Unknown; identical to SEQ ID NO: 3740
  Description of Unknown: uncultivated organism sequence
  Category: MG61 effectors repeat
  Description: MG61-2 effector repeat

SEQ ID NO: 3745 - DNA, 35 bp, Unknown; identical to SEQ ID NO: 3740
  Description of Unknown: uncultivated organism sequence
  Category: MG61 effectors repeat
  Description: MG61-2 effector repeat

SEQ ID NO: 3746 - DNA, 35 bp, Unknown
  Description of Unknown: uncultivated organism sequence
  Category: MG61 effectors repeat
  Description: MG61-3 effector repeat
gttataaagaacaaataaatgcctgctgttgcagg

SEQ ID NO: 3747 - DNA, 35 bp, Unknown; identical to SEQ ID NO: 3746
  Description of Unknown: uncultivated organism sequence
  Category: MG61 effectors repeat
  Description: MG61-3 effector repeat

SEQ ID NO: 3748 - DNA, 35 bp, Unknown; identical to SEQ ID NO: 3746
  Description of Unknown: uncultivated organism sequence
  Category: MG61 effectors repeat
  Description: MG61-3 effector repeat

SEQ ID NO: 3749 - DNA, 35 bp, Unknown; identical to SEQ ID NO: 3746
  Description of Unknown: uncultivated organism sequence
  Category: MG61 effectors repeat
  Description: MG61-3 effector repeat

SEQ ID NO: 3750 - DNA, 35 bp, Unknown; identical to SEQ ID NO: 3746
  Description of Unknown: uncultivated organism sequence
  Category: MG61 effectors repeat
  Description: MG61-3 effector repeat

SEQ ID NO: 3751 - DNA, 35 bp, Unknown; identical to SEQ ID NO: 3746
  Description of Unknown: uncultivated organism sequence
  Category: MG61 effectors repeat
  Description: MG61-3, MG61-12 effectors repeat

SEQ ID NO: 3752 - DNA, 36 bp, Unknown
  Description of Unknown: uncultivated organism sequence
  Category: MG61 effectors repeat
  Description: MG61-4 effector repeat
agttataaggaacaataaatgcctgctgctgcaggc

SEQ ID NO: 3753 - DNA, 36 bp, Unknown; identical to SEQ ID NO: 3752
  Description of Unknown: uncultivated organism sequence
  Category: MG61 effectors repeat
  Description: MG61-4 effector repeat

SEQ ID NO: 3754 - DNA, 36 bp, Unknown; identical to SEQ ID NO: 3752
  Description of Unknown: uncultivated organism sequence
  Category: MG61 effectors repeat
  Description: MG61-4 effector repeat

SEQ ID NO: 3755 - DNA, 36 bp, Unknown; identical to SEQ ID NO: 3752
  Description of Unknown: uncultivated organism sequence
  Category: MG61 effectors repeat
  Description: MG61-4 effector repeat

SEQ ID NO: 3756 - DNA, 36 bp, Unknown; identical to SEQ ID NO: 3752
  Description of Unknown: uncultivated organism sequence
  Category: MG61 effectors repeat
  Description: MG61-4 effector repeat

SEQ ID NO: 3757 - DNA, 36 bp, Unknown; identical to SEQ ID NO: 3752
  Description of Unknown: uncultivated organism sequence
  Category: MG61 effectors repeat
  Description: MG61-4 effector repeat

SEQ ID NO: 3758 - DNA, 36 bp, Unknown; identical to SEQ ID NO: 3752
  Description of Unknown: uncultivated organism sequence
  Category: MG61 effectors repeat
  Description: MG61-4 effector repeat

SEQ ID NO: 3759 - DNA, 36 bp, Unknown; identical to SEQ ID NO: 3752
  Description of Unknown: uncultivated organism sequence
  Category: MG61 effectors repeat
  Description: MG61-4 effector repeat

SEQ ID NO: 3760 - DNA, 36 bp, Unknown; identical to SEQ ID NO: 3752
  Description of Unknown: uncultivated organism sequence
  Category: MG61 effectors repeat
  Description: MG61-4, MG61-7, MG61-8, MG61-9, MG61-10, MG61-11, MG61-13, MG61-14, MG61-15 effectors repeat

SEQ ID NO: 3761 - DNA, 36 bp, Unknown
  Description of Unknown: uncultivated organism sequence
  Category: MG61 effectors repeat
  Description: MG61-5 effector repeat
gttaaaaggatcaaataaatacctgctgttgcaggc

SEQ ID NO: 3762 - DNA, 36 bp, Unknown; identical to SEQ ID NO: 3761
  Description of Unknown: uncultivated organism sequence
  Category: MG61 effectors repeat
  Description: MG61-5 effector repeat

SEQ ID NO: 3763 - DNA, 36 bp, Unknown; identical to SEQ ID NO: 3761
  Description of Unknown: uncultivated organism sequence
  Category: MG61 effectors repeat
  Description: MG61-5 effector repeat

SEQ ID NO: 3764 - DNA, 36 bp, Unknown; identical to SEQ ID NO: 3761
  Description of Unknown: uncultivated organism sequence
  Category: MG61 effectors repeat
  Description: MG61-5 effector repeat

SEQ ID NO: 3765 - DNA, 36 bp, Unknown; identical to SEQ ID NO: 3761
  Description of Unknown: uncultivated organism sequence
  Category: MG61 effectors repeat
  Description: MG61-5, MG61-6, MG61-16 effectors repeat

SEQ ID NO: 3766 - DNA, 36 bp, Unknown; identical to SEQ ID NO: 3761
  Description of Unknown: uncultivated organism sequence
  Category: MG61 effectors repeat
  Description: MG61-6 effector repeat

SEQ ID NO: 3767 - DNA, 36 bp, Unknown; identical to SEQ ID NO: 3761
  Description of Unknown: uncultivated organism sequence
  Category: MG61 effectors repeat
  Description: MG61-6 effector repeat

SEQ ID NO: 3768 - DNA, 36 bp, Unknown; identical to SEQ ID NO: 3761
  Description of Unknown: uncultivated organism sequence
  Category: MG61 effectors repeat
  Description: MG61-6 effector repeat

SEQ ID NO: 3769 - DNA, 36 bp, Unknown; identical to SEQ ID NO: 3761
  Description of Unknown: uncultivated organism sequence
  Category: MG61 effectors repeat
  Description: MG61-6 effector repeat

SEQ ID NO: 3770 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3771 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3772 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3773 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3774 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3775 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3776 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3777 - DNA, 36 bp, Unknown; identical to SEQ ID NO: 3752
  Description of Unknown: uncultivated organism sequence
  Category: MG61 effectors repeat
  Description: MG61-7 effector repeat

SEQ ID NO: 3778 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3779 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3780 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3781 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3782 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3783 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3784 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3785 - DNA, 36 bp, Unknown; identical to SEQ ID NO: 3752
  Description of Unknown: uncultivated organism sequence
  Category: MG61 effectors repeat
  Description: MG61-8 effector repeat

SEQ ID NO: 3786 - DNA, 36 bp, Unknown; identical to SEQ ID NO: 3752
  Description of Unknown: uncultivated organism sequence
  Category: MG61 effectors repeat
  Description: MG61-9 effector repeat

SEQ ID NO: 3787 - DNA, 36 bp, Unknown; identical to SEQ ID NO: 3752
  Description of Unknown: uncultivated organism sequence
  Category: MG61 effectors repeat
  Description: MG61-9 effector repeat

SEQ ID NO: 3788 - DNA, 36 bp, Unknown; identical to SEQ ID NO: 3752
  Description of Unknown: uncultivated organism sequence
  Category: MG61 effectors repeat
  Description: MG61-9 effector repeat

SEQ ID NO: 3789 - DNA, 36 bp, Unknown; identical to SEQ ID NO: 3752
  Description of Unknown: uncultivated organism sequence
  Category: MG61 effectors repeat
  Description: MG61-9 effector repeat

SEQ ID NO: 3790 - DNA, 36 bp, Unknown; identical to SEQ ID NO: 3752
  Description of Unknown: uncultivated organism sequence
  Category: MG61 effectors repeat
  Description: MG61-9 effector repeat

SEQ ID NO: 3791 - DNA, 36 bp, Unknown; identical to SEQ ID NO: 3752
  Description of Unknown: uncultivated organism sequence
  Category: MG61 effectors repeat
  Description: MG61-9 effector repeat

SEQ ID NO: 3792 - DNA, 36 bp, Unknown; identical to SEQ ID NO: 3752
  Description of Unknown: uncultivated organism sequence
  Category: MG61 effectors repeat
  Description: MG61-10 effector repeat

SEQ ID NO: 3793 - DNA, 36 bp, Unknown; identical to SEQ ID NO: 3752
  Description of Unknown: uncultivated organism sequence
  Category: MG61 effectors repeat
  Description: MG61-10 effector repeat

SEQ ID NO: 3794 - DNA, 36 bp, Unknown; identical to SEQ ID NO: 3752
  Description of Unknown: uncultivated organism sequence
  Category: MG61 effectors repeat
  Description: MG61-10 effector repeat

SEQ ID NO: 3795 - DNA, 36 bp, Unknown; identical to SEQ ID NO: 3752
  Description of Unknown: uncultivated organism sequence
  Category: MG61 effectors repeat
  Description: MG61-10 effector repeat

SEQ ID NO: 3796 - DNA, 36 bp, Unknown; identical to SEQ ID NO: 3752
  Description of Unknown: uncultivated organism sequence
  Category: MG61 effectors repeat
  Description: MG61-10 effector repeat

SEQ ID NO: 3797 - DNA, 36 bp, Unknown; identical to SEQ ID NO: 3752
  Description of Unknown: uncultivated organism sequence
  Category: MG61 effectors repeat
  Description: MG61-10 effector repeat

SEQ ID NO: 3798 - DNA, 36 bp, Unknown; identical to SEQ ID NO: 3752
  Description of Unknown: uncultivated organism sequence
  Category: MG61 effectors repeat
  Description: MG61-10 effector repeat

SEQ ID NO: 3799 - DNA, 36 bp, Unknown; identical to SEQ ID NO: 3752
  Description of Unknown: uncultivated organism sequence
  Category: MG61 effectors repeat
  Description: MG61-11 effector repeat

SEQ ID NO: 3800 - DNA, 36 bp, Unknown; identical to SEQ ID NO: 3752
  Description of Unknown: uncultivated organism sequence
  Category: MG61 effectors repeat
  Description: MG61-11 effector repeat

SEQ ID NO: 3801 - DNA, 36 bp, Unknown; identical to SEQ ID NO: 3752
  Description of Unknown: uncultivated organism sequence
  Category: MG61 effectors repeat
  Description: MG61-11 effector repeat

SEQ ID NO: 3802 - DNA, 36 bp, Unknown; identical to SEQ ID NO: 3752
  Description of Unknown: uncultivated organism sequence
  Category: MG61 effectors repeat
  Description: MG61-11 effector repeat

SEQ ID NO: 3803 - DNA, 36 bp, Unknown; identical to SEQ ID NO: 3752
  Description of Unknown: uncultivated organism sequence
  Category: MG61 effectors repeat
  Description: MG61-11 effector repeat

SEQ ID NO: 3804 - DNA, 36 bp, Unknown; identical to SEQ ID NO: 3752
  Description of Unknown: uncultivated organism sequence
  Category: MG61 effectors repeat
  Description: MG61-11 effector repeat

SEQ ID NO: 3805 - DNA, 36 bp, Unknown; identical to SEQ ID NO: 3752
  Description of Unknown: uncultivated organism sequence
  Category: MG61 effectors repeat
  Description: MG61-11 effector repeat

SEQ ID NO: 3806 - DNA, 35 bp, Unknown; identical to SEQ ID NO: 3746
  Description of Unknown: uncultivated organism sequence
  Category: MG61 effectors repeat
  Description: MG61-12 effector repeat

SEQ ID NO: 3807 - DNA, 35 bp, Unknown; identical to SEQ ID NO: 3746
  Description of Unknown: uncultivated organism sequence
  Category: MG61 effectors repeat
  Description: MG61-12 effector repeat

SEQ ID NO: 3808 - DNA, 35 bp, Unknown; identical to SEQ ID NO: 3746
  Description of Unknown: uncultivated organism sequence
  Category: MG61 effectors repeat
  Description: MG61-12 effector repeat

SEQ ID NO: 3809 - DNA, 35 bp, Unknown; identical to SEQ ID NO: 3746
  Description of Unknown: uncultivated organism sequence
  Category: MG61 effectors repeat
  Description: MG61-12 effector repeat

SEQ ID NO: 3810 - DNA, 35 bp, Unknown; identical to SEQ ID NO: 3746
  Description of Unknown: uncultivated organism sequence
  Category: MG61 effectors repeat
  Description: MG61-12 effector repeat

SEQ ID NO: 3811 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3812 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3813 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3814 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3815 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3816 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3817 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3818 - DNA, 36 bp, Unknown; identical to SEQ ID NO: 3752
  Description of Unknown: uncultivated organism sequence
  Category: MG61 effectors repeat
  Description: MG61-13 effector repeat

SEQ ID NO: 3819 - DNA, 36 bp, Unknown; identical to SEQ ID NO: 3752
  Description of Unknown: uncultivated organism sequence
  Category: MG61 effectors repeat
  Description: MG61-14 effector repeat

SEQ ID NO: 3820 - DNA, 36 bp, Unknown; identical to SEQ ID NO: 3752
  Description of Unknown: uncultivated organism sequence
  Category: MG61 effectors repeat
  Description: MG61-14 effector repeat

SEQ ID NO: 3821 - DNA, 36 bp, Unknown; identical to SEQ ID NO: 3752
  Description of Unknown: uncultivated organism sequence
  Category: MG61 effectors repeat
  Description: MG61-14 effector repeat

SEQ ID NO: 3822 - DNA, 36 bp, Unknown; identical to SEQ ID NO: 3752
  Description of Unknown: uncultivated organism sequence
  Category: MG61 effectors repeat
  Description: MG61-14 effector repeat

SEQ ID NO: 3823 - DNA, 36 bp, Unknown; identical to SEQ ID NO: 3752
  Description of Unknown: uncultivated organism sequence
  Category: MG61 effectors repeat
  Description: MG61-14 effector repeat

SEQ ID NO: 3824 - DNA, 36 bp, Unknown; identical to SEQ ID NO: 3752
  Description of Unknown: uncultivated organism sequence
  Category: MG61 effectors repeat
  Description: MG61-14 effector repeat

SEQ ID NO: 3825 - DNA, 36 bp, Unknown; identical to SEQ ID NO: 3752
  Description of Unknown: uncultivated organism sequence
  Category: MG61 effectors repeat
  Description: MG61-15 effector repeat

SEQ ID NO: 3826 - DNA, 36 bp, Unknown; identical to SEQ ID NO: 3752
  Description of Unknown: uncultivated organism sequence
  Category: MG61 effectors repeat
  Description: MG61-15 effector repeat

SEQ ID NO: 3827 - DNA, 36 bp, Unknown; identical to SEQ ID NO: 3752
  Description of Unknown: uncultivated organism sequence
  Category: MG61 effectors repeat
  Description: MG61-15 effector repeat

SEQ ID NO: 3828 - DNA, 36 bp, Unknown; identical to SEQ ID NO: 3752
  Description of Unknown: uncultivated organism sequence
  Category: MG61 effectors repeat
  Description: MG61-15 effector repeat

SEQ ID NO: 3829 - DNA, 36 bp, Unknown; identical to SEQ ID NO: 3752
  Description of Unknown: uncultivated organism sequence
  Category: MG61 effectors repeat
  Description: MG61-15 effector repeat

SEQ ID NO: 3830 - DNA, 36 bp, Unknown; identical to SEQ ID NO: 3752
  Description of Unknown: uncultivated organism sequence
  Category: MG61 effectors repeat
  Description: MG61-15 effector repeat

SEQ ID NO: 3831 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3832 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3833 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3834 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3835 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3836 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3837 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3838 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3839 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3840 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3841 - DNA, 36 bp, Unknown; identical to SEQ ID NO: 3761
  Description of Unknown: uncultivated organism sequence
  Category: MG61 effectors repeat
  Description: MG61-16 effector repeat

SEQ ID NO: 3842 - DNA, 36 bp, Unknown
  Description of Unknown: uncultivated organism sequence
  Category: MG61 effectors repeat
  Description: MG61-17 effector repeat
ggttataaggaagcaataaatgcctgctgatgcagg

SEQ ID NO: 3843 - DNA, 36 bp, Unknown; identical to SEQ ID NO: 3842
  Description of Unknown: uncultivated organism sequence
  Category: MG61 effectors repeat
  Description: MG61-17 effector repeat

SEQ ID NO: 3844 - DNA, 36 bp, Unknown; identical to SEQ ID NO: 3842
  Description of Unknown: uncultivated organism sequence
  Category: MG61 effectors repeat
  Description: MG61-17 effector repeat

SEQ ID NO: 3845 - DNA, 36 bp, Unknown; identical to SEQ ID NO: 3842
  Description of Unknown: uncultivated organism sequence
  Category: MG61 effectors repeat
  Description: MG61-17 effector repeat

SEQ ID NO: 3846 - DNA, 36 bp, Unknown; identical to SEQ ID NO: 3842
  Description of Unknown: uncultivated organism sequence
  Category: MG61 effectors repeat
  Description: MG61-17 effector repeat

SEQ ID NO: 3847 - DNA, 36 bp, Unknown; identical to SEQ ID NO: 3842
  Description of Unknown: uncultivated organism sequence
  Category: MG61 effectors repeat
  Description: MG61-17 effector repeat

SEQ ID NO: 3848 - DNA, 35 bp, Unknown
  Description of Unknown: uncultivated organism sequence
  Category: MG62 effectors repeat
  Description: MG62-2 effector repeat
tttaaacatagtatctaatttctacttttgtagat

SEQ ID NO: 3849 - DNA, 37 bp, Unknown
  Description of Unknown: uncultivated organism sequence
  Category: MG62 effectors repeat
  Description: MG62-3 effector repeat
gtttaaacatagtatctaatttctactttggtagata

SEQ ID NO: 3850 - DNA, 37 bp, Unknown
  Description of Unknown: uncultivated organism sequence
  Category: MG62 effectors repeat
  Description: MG62-3 effector repeat
gtttaaacatagtatctaatttctactttggtagatt

SEQ ID NO: 3851 - DNA, 43 bp, Unknown
  Description of Unknown: uncultivated organism sequence
  Category: MG77 guide RNA
  Description: MG77-1 sgRNA
  modified_base (20)..(43): a, c, t, g, unknown or other
  misc_feature (20)..(43): This region may encompass 20 or 24 nucleotides
aatttctactctggtagatnnnnnnnnnnnnnnnnnnnnnnnn

SEQ ID NO: 3852 - DNA, 43 bp, Unknown
  Description of Unknown: uncultivated organism sequence
  Category: MG77 guide RNA
  Description: MG77-2 sgRNA
  modified_base (20)..(43): a, c, t, g, unknown or other
  misc_feature (20)..(43): This region may encompass 20 or 24 nucleotides
aatttctacttgtgtagatnnnnnnnnnnnnnnnnnnnnnnnn

SEQ ID NO: 3853 - DNA, 43 bp, Unknown; identical to SEQ ID NO: 3730
  Description of Unknown: uncultivated organism sequence
  Category: MG78 guide RNA
  Description: MG78-1 sgRNA
  modified_base (20)..(43): a, c, t, g, unknown or other
  misc_feature (20)..(43): This region may encompass 20 or 24 nucleotides

SEQ ID NO: 3854 - DNA, 43 bp, Unknown
  Description of Unknown: uncultivated organism sequence
  Category: MG79 guide RNA
  Description: MG79-1 sgRNA
  modified_base (20)..(43): a, c, t, g, unknown or other
  misc_feature (20)..(43): This region may encompass 20 or 24 nucleotides
aatttctactaatgtagatnnnnnnnnnnnnnnnnnnnnnnnn

SEQ ID NO: 3855 - DNA, 43 bp, Unknown
  Description of Unknown: uncultivated organism sequence
  Category: MG79 guide RNA
  Description: MG79-2 sgRNA
  modified_base (20)..(43): a, c, t, g, unknown or other
  misc_feature (20)..(43): This region may encompass 20 or 24 nucleotides
aatttctactattgtagatnnnnnnnnnnnnnnnnnnnnnnnn

SEQ ID NO: 3856 - DNA, 43 bp, Unknown; identical to SEQ ID NO: 3695
  Description of Unknown: uncultivated organism sequence
  Category: MG79 guide RNA
  Description: MG79-3 sgRNA
  modified_base (20)..(43): a, c, t, g, unknown or other
  misc_feature (20)..(43): This region may encompass 20 or 24 nucleotides

SEQ ID NO: 3857 - DNA, 43 bp, Unknown; identical to SEQ ID NO: 3855
  Description of Unknown: uncultivated organism sequence
  Category: MG79 guide RNA
  Description: MG79-4 sgRNA
  modified_base (20)..(43): a, c, t, g, unknown or other
  misc_feature (20)..(43): This region may encompass 20 or 24 nucleotides

SEQ ID NO: 3858 - DNA, 24 bp, Artificial Sequence
  Description of Artificial Sequence: Synthetic oligonucleotide
  Category: Spacer segment
  Description: spacer segment 3
gtcgaggcttgcgacgtggtggct

SEQ ID NO: 3859 - DNA, 24 bp, Artificial Sequence
  Description of Artificial Sequence: Synthetic oligonucleotide
  Category: Spacer segment
  Description: Spacer segment 4
tggagatatcttgaaccttgcatc

SEQ ID NO: 3860 - DNA, 24 bp, Artificial Sequence
  Description of Artificial Sequence: Synthetic oligonucleotide
  Category: spacer segment
  Description: spacer segment 1
cgtgagccaccacgtcgcaagcct

SEQ ID NO: 3861 - DNA, 24 bp, Artificial Sequence
  Description of Artificial Sequence: Synthetic oligonucleotide
  Category: spacer segment
  Description: spacer segment 2
gtcgaggcttgcgacgtggtggct

SEQ ID NO: 3862 - skipped

SEQ ID NO: 3863 - DNA, 2 bp, Artificial Sequence
  Description of Artificial Sequence: Synthetic oligonucleotide
  Category: MG19 active effectors PAM
  Description: MG19-2 PAM
ta

SEQ ID NO: 3864 - DNA, 2 bp, Artificial Sequence
  Description of Artificial Sequence: Synthetic oligonucleotide
  Category: MG19 active effectors PAM
  Description: MG19-3 PAM
ta

SEQ ID NO: 3865 - DNA, 2 bp, Artificial Sequence
  Description of Artificial Sequence: Synthetic oligonucleotide
  Category: MG19 active effectors PAM
  Description: MG19-4 PAM
tr

SEQ ID NO: 3866 - DNA, 3 bp, Artificial Sequence
  Description of Artificial Sequence: Synthetic oligonucleotide
  Category: MG19 active effectors PAM
  Description: MG19-5 PAM
ttr

SEQ ID NO: 3867 - DNA, 3 bp, Artificial Sequence
  Description of Artificial Sequence: Synthetic oligonucleotide
  Category: MG20 active effectors PAM
  Description: MG20-1 PAM
tta

SEQ ID NO: 3868 - DNA, 4 bp, Artificial Sequence
  Description of Artificial Sequence: Synthetic oligonucleotide
  Category: MG28 active effectors PAM
  Description: MG28-1 PAM (5') from NGS
  modified_base (4)..(4): a, c, t, g, unknown or other
tttn

SEQ ID NO: 3869 - DNA, 26 bp, Unknown
  Description of Unknown: uncultivated organism sequence
  Category: MG28 effectors repeat
  Description: MG28-10, MG28-11 effectors repeat
catataaaatttctactattgtagat

SEQ ID NO: 3870 - DNA, 4 bp, Artificial Sequence
  Description of Artificial Sequence: Synthetic oligonucleotide
  Category: MG29 active effectors PAM
  Description: MG29-1 PAM (5')
kttg

SEQ ID NO: 3871 - DNA, 3 bp, Artificial Sequence
  Description of Artificial Sequence: Synthetic oligonucleotide
  Category: MG29 active effectors PAM
  Description: MG29-1 PAM (5') from NGS
  modified_base (3)..(3): a, c, t, g, unknown or other
yyn

SEQ ID NO: 3872 - DNA, 4 bp, Artificial Sequence
  Description of Artificial Sequence: Synthetic oligonucleotide
  Category: MG29 active effectors PAM
  Description: MG29-5 PAM
  modified_base (4)..(4): a, c, t, g, unknown or other
yyyn

SEQ ID NO: 3873 - DNA, 4 bp, Artificial Sequence
  Description of Artificial Sequence: Synthetic oligonucleotide
  Category: MG30 active effectors PAM
  Description: MG30-1 PAM (5')
  modified_base (4)..(4): a, c, t, g, unknown or other
tttn

SEQ ID NO: 3874 - DNA, 4 bp, Artificial Sequence
  Description of Artificial Sequence: Synthetic oligonucleotide
  Category: MG31 active effectors PAM
  Description: MG31-1 PAM
tttr

SEQ ID NO: 3875 - DNA, 4 bp, Artificial Sequence
  Description of Artificial Sequence: Synthetic oligonucleotide
  Category: MG31 active effectors PAM
  Description: MG31-1 PAM (5') from NGS
  modified_base (4)..(4): a, c, t, g, unknown or other
yttn

SEQ ID NO: 3876 - DNA, 4 bp, Artificial Sequence
  Description of Artificial Sequence: Synthetic oligonucleotide
  Category: MG31 active effectors, MG32 active effectors PAM (5')
  Description: MG31-1, MG32-1 PAM (5')
yttm

SEQ ID NO: 3877 - DNA, 4 bp, Artificial Sequence
  Description of Artificial Sequence: Synthetic oligonucleotide
  Category: MG32 active effectors PAM
  Description: MG32-1 PAM (5') from NGS
  modified_base (4)..(4): a, c, t, g, unknown or other
tttn

SEQ ID NO: 3878 - skipped

SEQ ID NO: 3879 - DNA, 2 bp, Artificial Sequence
  Description of Artificial Sequence: Synthetic oligonucleotide
  Category: MG57 active effectors PAM
  Description: MG57-1 PAM
  modified_base (2)..(2): a, c, t, g, unknown or other
yn

SEQ ID NO: 3880 - DNA, 4 bp, Artificial Sequence
  Description of Artificial Sequence: Synthetic oligonucleotide
  Category: MG57 active effectors PAM
  Description: MG57-2 PAM
  modified_base (3)..(3): a, c, t, g, unknown or other
yynw

SEQ ID NO: 3881 - DNA, 3 bp, Artificial Sequence
  Description of Artificial Sequence: Synthetic oligonucleotide
  Category: MG59 active effectors PAM
  Description: MG59-1 PAM
  modified_base (3)..(3): a, c, t, g, unknown or other
yyn

SEQ ID NO: 3882 - DNA, 4 bp, Artificial Sequence
  Description of Artificial Sequence: Synthetic oligonucleotide
  Category: MG59 active effectors PAM
  Description: MG59-2 PAM
yttv

SEQ ID NO: 3883 - DNA, 3 bp, Artificial Sequence
  Description of Artificial Sequence: Synthetic oligonucleotide
  Category: MG77 active effectors PAM
  Description: MG77-1 PAM
  modified_base (3)..(3): a, c, t, g, unknown or other
ttn

SEQ ID NO: 3884 - DNA, 3 bp, Artificial Sequence
  Description of Artificial Sequence: Synthetic oligonucleotide
  Category: MG77 active effectors PAM
  Description: MG77-2 PAM
  modified_base (3)..(3): a, c, t, g, unknown or other
ttn

SEQ ID NO: 3885 - DNA, 3 bp, Artificial Sequence
  Description of Artificial Sequence: Synthetic oligonucleotide
  Category: MG78 active effectors PAM
  Description: MG78-1 PAM
  modified_base (3)..(3): a, c, t, g, unknown or other
yyn

SEQ ID NO: 3886 - DNA, 3 bp, Artificial Sequence
  Description of Artificial Sequence: Synthetic oligonucleotide
  Category: MG79 active effectors PAM
  Description: MG79-1 PAM
ttr

SEQ ID NO: 3887 - DNA, 3 bp, Artificial Sequence
  Description of Artificial Sequence: Synthetic oligonucleotide
  Category: MG79 active effectors PAM
  Description: MG79-2 PAM
ttr

SEQ ID NO: 3888 - DNA, 4 bp, Artificial Sequence
  Description of Artificial Sequence: Synthetic oligonucleotide
  Category: MG79 active effectors PAM
  Description: MG79-3 PAM
  modified_base (4)..(4): a, c, t, g, unknown or other
tttn

SEQ ID NO: 3889 - DNA, 3 bp, Artificial Sequence
  Description of Artificial Sequence: Synthetic oligonucleotide
  Category: MG79 active effectors PAM
  Description: MG79-4 PAM
  modified_base (3)..(3): a, c, t, g, unknown or other
ttn

SEQ ID NO: 3890 - DNA, 10 bp, Artificial Sequence
  Description of Artificial Sequence: Synthetic oligonucleotide
  Category: PAM Sequence
  Description: PAM sequence corresponding to MG29-1 Target Loci 1
aacacagttg

SEQ ID NO: 3891 - DNA, 10 bp, Artificial Sequence
  Description of Artificial Sequence: Synthetic oligonucleotide
  Category: PAM Sequence
  Description: PAM sequence corresponding to MG29-1 Target Loci 2
tacagttttg

SEQ ID NO: 3892 - DNA, 10 bp, Artificial Sequence
  Description of Artificial Sequence: Synthetic oligonucleotide
  Category: PAM Sequence
  Description: PAM sequence corresponding to MG29-1 Target Loci 3
tttgaggttg

SEQ ID NO: 3893 - DNA, 10 bp, Artificial Sequence
  Description of Artificial Sequence: Synthetic oligonucleotide
  Category: PAM Sequence
  Description: PAM sequence corresponding to MG29-1 Target Loci 4
tttgtatttg

SEQ ID NO: 3894 - DNA, 10 bp, Artificial Sequence
  Description of Artificial Sequence: Synthetic oligonucleotide
  Category: PAM Sequence
  Description: PAM sequence corresponding to MG29-1 Target Loci 5
agttactttg

SEQ ID NO: 3895 - DNA, 10 bp, Artificial Sequence
  Description of Artificial Sequence: Synthetic oligonucleotide
  Category: PAM Sequence
  Description: PAM sequence corresponding to MG29-1 Target Loci 6
gatgaagttg

SEQ ID NO: 3896 - DNA, 10 bp, Artificial Sequence
  Description of Artificial Sequence: Synthetic oligonucleotide
  Category: PAM Sequence
  Description: PAM sequence corresponding to MG29-1 Target Loci 7
tagctgtttg

SEQ ID NO: 3897 - DNA, 10 bp, Artificial Sequence
  Description of Artificial Sequence: Synthetic oligonucleotide
  Category: PAM Sequence
  Description: PAM sequence corresponding to MG29-1 Target Loci 8
atgggctttg

SEQ ID NO: 3898 - DNA, 10 bp, Artificial Sequence
  Description of Artificial Sequence: Synthetic oligonucleotide
  Category: PAM Sequence
  Description: PAM sequence corresponding to MG29-1 Target Loci 9
gggcaggttg

SEQ ID NO: 3899 - DNA, 10 bp, Artificial Sequence
  Description of Artificial Sequence: Synthetic oligonucleotide
  Category: PAM Sequence
  Description: PAM sequence corresponding to MG29-1 Target Loci 10
tacatagttg

SEQ ID NO: 3900 - DNA, 10 bp, Artificial Sequence
  Description of Artificial Sequence: Synthetic oligonucleotide
  Category: PAM Sequence
  Description: PAM sequence corresponding to MG29-1 Target Loci 11
tacgcatttg

SEQ ID NO: 3901 - DNA, 10 bp, Artificial Sequence
  Description of Artificial Sequence: Synthetic oligonucleotide
  Category: PAM Sequence
  Description: PAM sequence corresponding to MG29-1 Target Loci 12
ccgcaagttg

SEQ ID NO: 3902 - DNA, 10 bp, Artificial Sequence
  Description of Artificial Sequence: Synthetic oligonucleotide
  Category: PAM Sequence
  Description: PAM sequence corresponding to MG31-1 Target Loci 1
gttttcttta

SEQ ID NO: 3903 - DNA, 10 bp, Artificial Sequence
  Description of Artificial Sequence: Synthetic oligonucleotide
  Category: PAM Sequence
  Description: PAM sequence corresponding to MG31-1 Target Loci 2
tacagttttg

SEQ ID NO: 3904 - DNA, 10 bp, Artificial Sequence
  Description of Artificial Sequence: Synthetic oligonucleotide
  Category: PAM Sequence
  Description: PAM sequence corresponding to MG31-1 Target Loci 3
agaactttta

SEQ ID NO: 3905 - DNA, 10 bp, Artificial Sequence
  Description of Artificial Sequence: Synthetic oligonucleotide
  Category: PAM Sequence
  Description: PAM sequence corresponding to MG31-1 Target Loci 4
tttgtatttg

SEQ ID NO: 3906 - DNA, 10 bp, Artificial Sequence
  Description of Artificial Sequence: Synthetic oligonucleotide
  Category: PAM Sequence
  Description: PAM sequence corresponding to MG31-1 Target Loci 5
agttactttg

SEQ ID NO: 3907 - DNA, 10 bp, Artificial Sequence
  Description of Artificial Sequence: Synthetic oligonucleotide
  Category: PAM Sequence
  Description: PAM sequence corresponding to MG31-1 Target Loci 6
ttttttttta

SEQ ID NO: 3908 - DNA, 10 bp, Artificial Sequence
  Description of Artificial Sequence: Synthetic oligonucleotide
  Category: PAM Sequence
  Description: PAM sequence corresponding to MG31-1 Target Loci 7
tagctgtttg

SEQ ID NO: 3909 - DNA, 10 bp, Artificial Sequence
  Description of Artificial Sequence: Synthetic oligonucleotide
  Category: PAM Sequence
  Description: PAM sequence corresponding to MG31-1 Target Loci 8
atgggctttg

SEQ ID NO: 3910 - DNA, 10 bp, Artificial Sequence
  Description of Artificial Sequence: Synthetic oligonucleotide
  Category: PAM Sequence
  Description: PAM sequence corresponding to MG31-1 Target Loci 9
tccctcttta

SEQ ID NO: 3911 - DNA, 10 bp, Artificial Sequence
  Description of Artificial Sequence: Synthetic oligonucleotide
  Category: PAM Sequence
  Description: PAM sequence corresponding to MG31-1 Target Loci 10
acaaatttta

SEQ ID NO: 3912 - DNA, 10 bp, Artificial Sequence
  Description of Artificial Sequence: Synthetic oligonucleotide
  Category: PAM Sequence
  Description: PAM sequence corresponding to MG31-1 Target Loci 11
tacgcatttg

SEQ ID NO: 3913 - DNA, 10 bp, Artificial Sequence
  Description of Artificial Sequence: Synthetic oligonucleotide
  Category: PAM Sequence
  Description: PAM sequence corresponding to MG31-1 Target Loci 12
gaaaaattta

SEQ ID NO: 3914 - DNA, 24 bp, Artificial Sequence
  Description of Artificial Sequence: Synthetic oligonucleotide
  Category: Target Sequence
  Description: MG29-1 Target Loci 1
tgtcagaagcaaatgtaagcaata

SEQ ID NO: 3915 - DNA, 24 bp, Artificial Sequence
  Description of Artificial Sequence: Synthetic oligonucleotide
  Category: Target Sequence
  Description: MG29-1 Target Loci 2
ctgaaaggttattgttgtgtttgt

SEQ ID NO: 3916 - DNA, 24 bp, Artificial Sequence
  Description of Artificial Sequence: Synthetic oligonucleotide
  Category: Target Sequence
  Description: MG29-1 Target Loci 3
ctagtgaacacagttgtgtcagaa

SEQ ID NO: 3917 - DNA, 24 bp, Artificial Sequence
  Description of Artificial Sequence: Synthetic oligonucleotide
  Category: Target Sequence
  Description: MG29-1 Target Loci 4
tgaagtcttacaaggttatcttat

SEQ ID NO: 3918 - DNA, 24 bp, Artificial Sequence
  Description of Artificial Sequence: Synthetic oligonucleotide
  Category: Target Sequence
  Description: MG29-1 Target Loci 5
cactttccttagtgcgcaaaagaa

SEQ ID NO: 3919 - DNA, 24 bp, Artificial Sequence
  Description of Artificial Sequence: Synthetic oligonucleotide
  Category: Target Sequence
  Description: MG29-1 Target Loci 6
gtggtgaggccctgggcaggttgg

SEQ ID NO: 3920 - DNA, 24 bp, Artificial Sequence
  Description of Artificial Sequence: Synthetic oligonucleotide
  Category: Target Sequence
  Description: MG29-1 Target Loci 7
ggaggtcagaaatagggggtccag

SEQ ID NO: 3921 - DNA, 24 bp, Artificial Sequence
  Description of Artificial Sequence: Synthetic oligonucleotide
  Category: Target Sequence
  Description: MG29-1 Target Loci 8
gaaagggggtggggggagtttgct

SEQ ID NO: 3922 - DNA, 24 bp, Artificial Sequence
  Description of Artificial Sequence: Synthetic oligonucleotide
  Category: Target Sequence
  Description: MG29-1 Target Loci 9
gtatcaaggttacaagacaggttt

SEQ ID NO: 3923 - DNA, 24 bp, Artificial Sequence
  Description of Artificial Sequence: Synthetic oligonucleotide
  Category: Target Sequence
  Description: MG29-1 Target Loci 10
tgtgagggagcaccgttctctaga

SEQ ID NO: 3924 - DNA, 24 bp, Artificial Sequence
  Description of Artificial Sequence: Synthetic oligonucleotide
  Category: Target Sequence
  Description: MG29-1 Target Loci 11
ggtagttttctgtggtcctattat

SEQ ID NO: 3925 - DNA, 24 bp, Artificial Sequence
  Description of Artificial Sequence: Synthetic oligonucleotide
  Category: Target Sequence
  Description: MG29-1 Target Loci 12
ccaggaaagttgatgtggtctgcg

SEQ ID NO: 3926 - DNA, 24 bp, Artificial Sequence
  Description of Artificial Sequence: Synthetic oligonucleotide
  Category: Target Sequence
  Description: MG31-1 Target Loci 1
gttattaatttcttgctacttgtc

SEQ ID NO: 3927 - DNA, 24 bp, Artificial Sequence
  Description of Artificial Sequence: Synthetic oligonucleotide
  Category: Target Sequence
  Description: MG31-1 Target Loci 2
ctgaaaggttattgttgtgtttgt

SEQ ID NO: 3928 - DNA, 24 bp, Artificial Sequence
  Description of Artificial Sequence: Synthetic oligonucleotide
  Category: Target Sequence
  Description: MG31-1 Target Loci 3
gtgttagtacagttttgctgaaag

SEQ ID NO: 3929 - DNA, 24 bp, Artificial Sequence
  Description of Artificial Sequence: Synthetic oligonucleotide
  Category: Target Sequence
  Description: MG31-1 Target Loci 4
tgaagtcttacaaggttatcttat

SEQ ID NO: 3930 - DNA, 24 bp, Artificial Sequence
  Description of Artificial Sequence: Synthetic oligonucleotide
  Category: Target Sequence
  Description: MG31-1 Target Loci 5
cactttccttagtgcgcaaaagaa

SEQ ID NO: 3931 - DNA, 24 bp, Artificial Sequence
  Description of Artificial Sequence: Synthetic oligonucleotide
  Category: Target Sequence
  Description: MG31-1 Target Loci 6
cctaggatgtttgaattttattaa

SEQ ID NO: 3932 - DNA, 24 bp, Artificial Sequence
  Description of Artificial Sequence: Synthetic oligonucleotide
  Category: Target Sequence
  Description: MG31-1 Target Loci 7
ggaggtcagaaatagggggtccag

SEQ ID NO: 3933 - DNA, 24 bp, Artificial Sequence
  Description of Artificial Sequence: Synthetic oligonucleotide
  Category: Target Sequence
  Description: MG31-1 Target Loci 8
gaaagggggtggggggagtttgct

SEQ ID NO: 3934 - DNA, 24 bp, Artificial Sequence
  Description of Artificial Sequence: Synthetic oligonucleotide
  Category: Target Sequence
  Description: MG31-1 Target Loci 9
gccagagccggggtgtgcagacgg

SEQ ID NO: 3935 - DNA, 24 bp, Artificial Sequence
  Description of Artificial Sequence: Synthetic oligonucleotide
  Category: Target Sequence
  Description: MG31-1 Target Loci 10
cttggaccttgttttgcttactgt

SEQ ID NO: 3936 - DNA, 24 bp, Artificial Sequence
  Description of Artificial Sequence: Synthetic oligonucleotide
  Category: Target Sequence
  Description: MG31-1 Target Loci 11
ggtagttttctgtggtcctattat

SEQ ID NO: 3937 - DNA, 24 bp, Artificial Sequence
  Description of Artificial Sequence: Synthetic oligonucleotide
  Category: Target Sequence
  Description: MG31-1 Target Loci 12
atcataagaagttagcttgacgca

SEQ ID NO: 3938 - protein, 7 aa, Simian virus 40
  Category: NLS
  Description: SV40
PKKKRKV

SEQ ID NO: 3939 - protein, 16 aa, Unknown
  Description of Unknown: nucleoplasmin bipartite NLS sequence
  Category: NLS
  Description: nucleoplasmin bipartite NLS
KRPAATKKAGQAKKKK

SEQ ID NO: 3940 - protein, 9 aa, Unknown
  Description of Unknown: c-myc NLS sequence
  Category: NLS
  Description: c-myc NLS
PAAKRVKLD

SEQ ID NO: 3941 - protein, 11 aa, Unknown
  Description of Unknown: c-myc NLS sequence
  Category: NLS
  Description: c-myc NLS
RQRRNELKRSP

SEQ ID NO: 3942 - protein, 38 aa, Homo sapiens
  Category: NLS
  Description: hRNPA1 M9 NLS
NQSSNFGPMKGGNFGGRSSGPYGGGGQYFAKPRNQGGY

SEQ ID NO: 3943 - protein, 42 aa, Unknown
  Description of Unknown: Importin-alpha IBB domain sequence
  Category: NLS
  Description: Importin-alpha IBB domain
RMRIZFKNKGKDTAELRRRRVEVSVELRKAKKDEQILKRRNV

SEQ ID NO: 3944 - protein, 8 aa, Unknown
  Description of Unknown: Myoma T protein sequence
  Category: NLS
  Description: Myoma T protein
VSRKRPRP

SEQ ID NO: 3945 - protein, 8 aa, Unknown
  Description of Unknown: Myoma T protein sequence
  Category: NLS
  Description: Myoma T protein
PPKKARED

SEQ ID NO: 3946 - protein, 8 aa, Unknown
  Description of Unknown: p53 sequence
  Category: NLS
  Description: p53
PQPKKKPL

SEQ ID NO: 3947 - protein, 12 aa, Mus sp.
  Category: NLS
  Description: mouse c-abl IV
SALIKKKKKMAP

SEQ ID NO: 3948 - protein, 5 aa, Influenza virus
  Category: NLS
  Description: influenza virus NS1
DRLRR

SEQ ID NO: 3949 - protein, 7 aa, Influenza virus
  Category: NLS
  Description: influenza virus NS1
PKQKKRK

SEQ ID NO: 3950 - protein, 10 aa, Hepatitis delta virus
  Category: NLS
  Description: Hepatitis virus delta antigen
RKLKKKIKKL

SEQ ID NO: 3951 - protein, 10 aa, Mus sp.
  Category: NLS
  Description: mouse Mx1 protein
REKKKFLKRR

SEQ ID NO: 3952 - protein, 20 aa, Homo sapiens
  Category: NLS
  Description: human poly(ADP-ribose) polymerase
KRKGDEVDGVDEVAKKKSKK

SEQ ID NO: 3953 - protein, 17 aa, Homo sapiens
  Category: NLS
  Description: steroid hormone receptors (human) glucocorticoid
RKCLQAGMNLEARKTKK

SEQ ID NO: 3954 - DNA, 24 bp, Artificial Sequence
  Description of Artificial Sequence: Synthetic oligonucleotide
  Category: MG29 HEK targeting guides
  Description: MG29-1 guide sequence 1 for targeting Apolipoprotein
ccaggaaagttgatgtggtctgcg

SEQ ID NO: 3955 - DNA, 24 bp, Artificial Sequence
  Description of Artificial Sequence: Synthetic oligonucleotide
  Category: MG29 HEK targeting guides
  Description: MG29-1 guide sequence 1 for targeting HBB_R01
ctagtgaacacagttgtgtcagaa

SEQ ID NO: 3956 - DNA, 24 bp, Artificial Sequence
  Description of Artificial Sequence: Synthetic oligonucleotide
  Category: MG29 HEK targeting guides
  Description: MG29-1 guide sequence 2 for targeting HBB_R01
gtatcaaggttacaagacaggttt

SEQ ID NO: 3957 - DNA, 24 bp, Artificial Sequence
  Description of Artificial Sequence: Synthetic oligonucleotide
  Category: MG29 HEK targeting guides
  Description: MG29-1 guide sequence 3 for targeting HBB_R01
gtggtgaggccctgggcaggttgg

SEQ ID NO: 3958 - DNA, 24 bp, Artificial Sequence
  Description of Artificial Sequence: Synthetic oligonucleotide
  Category: MG29 HEK targeting guides
  Description: MG29-1 guide sequence 4 for targeting HBB_R01
tgtcagaagcaaatgtaagcaata

SEQ ID NO: 3959 - DNA, 24 bp, Artificial Sequence
  Description of Artificial Sequence: Synthetic oligonucleotide
  Category: MG29 HEK targeting guides
  Description: MG29-1 guide sequence 1 for targeting Apolipoprotein
tgtgagggagcaccgttctctaga

SEQ ID NO: 3960 - DNA, 24 bp, Artificial Sequence
  Description of Artificial Sequence: Synthetic oligonucleotide
  Category: MG29 HEK targeting guides
  Description: MG29-1 guide sequence 1 for targeting VEGFA
ccccgcctccgggcgcgggctccg

SEQ ID NO: 3961 - DNA, 24 bp, Artificial Sequence
  Description of Artificial Sequence: Synthetic oligonucleotide
  Category: MG29 HEK targeting guides
  Description: MG29-1 guide sequence 2 for targeting VEGFA
ccgaagcgagaacagcccagaagt

SEQ ID NO: 3962 - DNA, 24 bp, Artificial Sequence
  Description of Artificial Sequence: Synthetic oligonucleotide
  Category: MG29 HEK targeting guides
  Description: MG29-1 guide sequence 3 for targeting VEGFA
ccgcgcggaccacggctcctccga

SEQ ID NO: 3963 - DNA, 24 bp, Artificial Sequence
  Description of Artificial Sequence: Synthetic oligonucleotide
  Category: MG29 HEK targeting guides
  Description: MG29-1 guide sequence 4 for targeting VEGFA
gaagttggacgaaaagtttcagtg

SEQ ID NO: 3964 - DNA, 24 bp, Artificial Sequence
  Description of Artificial Sequence: Synthetic oligonucleotide
  Category: MG29 HEK targeting guides
  Description: MG29-1 guide sequence 5 for targeting VEGFA
gaggcggggtggagggggtcgggg

SEQ ID NO: 3965 - DNA, 24 bp, Artificial Sequence
  Description of Artificial Sequence: Synthetic oligonucleotide
  Category: MG29 HEK targeting guides
  Description: MG29-1 guide sequence 6 for targeting VEGFA
ggcgcgggctccggcccctgcccg

SEQ ID NO: 3966 - DNA, 24 bp, Artificial Sequence
  Description of Artificial Sequence: Synthetic oligonucleotide
  Category: MG31 HEK targeting guides
  Description: MG31-1 guide sequence 1 for targeting Apolipoprotein
atcataagaagttagcttgacgca

SEQ ID NO: 3967 - DNA, 24 bp, Artificial Sequence
  Description of Artificial Sequence: Synthetic oligonucleotide
  Category: MG31 HEK targeting guides
  Description: MG31-1 guide sequence 1 for targeting Albumin
cctaggatgtttgaattttattaa

SEQ ID NO: 3968 - DNA, 24 bp, Artificial Sequence
  Description of Artificial Sequence: Synthetic oligonucleotide
  Category: MG31 HEK targeting guides
  Description: MG29-1, MG31-1 guide sequence 1 for targeting Fibrinogen
ctgaaaggttattgttgtgtttgt

SEQ ID NO: 3969 - DNA, 24 bp, Artificial Sequence
  Description of Artificial Sequence: Synthetic oligonucleotide
  Category: MG31 HEK targeting guides
  Description: MG31-1 guide sequence 1 for targeting Apolipoprotein
cttggaccttgttttgcttactgt

SEQ ID NO: 3970 - DNA, 24 bp, Artificial Sequence
  Description of Artificial Sequence: Synthetic oligonucleotide
  Category: MG31 HEK targeting guides
  Description: MG29-1, MG31-1 guide sequence 2 for targeting Apolipoprotein
ggtagttttctgtggtcctattat

SEQ ID NO: 3971 - DNA, 24 bp, Artificial Sequence
  Description of Artificial Sequence: Synthetic oligonucleotide
  Category: MG31 HEK targeting guides
  Description: MG31-1 guide sequence 1 for targeting Fibrinogen
gtgttagtacagttttgctgaaag

SEQ ID NO: 3972 - DNA, 24 bp, Artificial Sequence
  Description of Artificial Sequence: Synthetic oligonucleotide
  Category: MG31 HEK targeting guides
  Description: MG31-1 guide sequence 2 for targeting Fibrinogen
gttattaatttcttgctacttgtc

SEQ ID NO: 3973 - DNA, 24 bp, Artificial Sequence
  Description of Artificial Sequence: Synthetic oligonucleotide
  Category: MG32 HEK targeting guides
  Description: MG28-1, MG28-1, MG30-1, MG30-1, MG32-1 guide sequence 1 for targeting Fibrinogen
agcaaaactgtactaacactaaaa

SEQ ID NO: 3974 - DNA, 24 bp, Artificial Sequence
  Description of Artificial Sequence: Synthetic oligonucleotide
  Category: MG32 HEK targeting guides
  Description: MG28-1, MG28-1, MG30-1, MG30-1, MG32-1 guide sequence 1 for targeting VEGFA
agtgcgacgccgcgagccccgacc

SEQ ID NO: 3975 - DNA, 24 bp, Artificial Sequence
  Description of Artificial Sequence: Synthetic oligonucleotide
  Category: MG32 HEK targeting guides
  Description: MG28-1, MG30-1, MG32-1 guide sequence 2 for targeting VEGFA
caaagcccattccctctttagcca

SEQ ID NO: 3976 - DNA, 24 bp, Artificial Sequence
  Description of Artificial Sequence: Synthetic oligonucleotide
  Category: MG32 HEK targeting guides
  Description: MG28-1, MG28-1, MG29-1, MG30-1, MG30-1, MG31-1, MG32-1 guide sequence 1 for targeting Albumin
cactttccttagtgcgcaaaagaa

SEQ ID NO: 3977 - DNA, 24 bp, Artificial Sequence
  Description of Artificial Sequence: Synthetic oligonucleotide
  Category: MG32 HEK targeting guides
  Description: MG28-1, MG28-1, MG30-1, MG30-1, MG32-1 guide sequence 1 for targeting VEGFA
cgtccaacttctgggctgttctcg

SEQ ID NO: 3978 - DNA, 24 bp, Artificial Sequence
  Description of Artificial Sequence: Synthetic oligonucleotide
  Category: MG32 HEK targeting guides
  Description: MG28-1, MG30-1, MG32-1 guide sequence 1 for targeting Apolipoprotein
ctaagacaaattttacttggacct

SEQ ID NO: 3979 - DNA, 24 bp, Artificial Sequence
  Description of Artificial Sequence: Synthetic oligonucleotide
  Category: MG32 HEK targeting guides
  Description: MG28-1, MG28-1, MG29-1, MG30-1, MG30-1, MG31-1, MG32-1 guide sequence 1 for targeting VEGFA
gaaagggggtggggggagtttgct

SEQ ID NO: 3980 - DNA, 24 bp, Artificial Sequence
  Description of Artificial Sequence: Synthetic oligonucleotide
  Category: MG32 HEK targeting guides
  Description: MG28-1, MG28-1, MG30-1, MG30-1, MG31-1, MG32-1 guide sequence 2 for targeting VEGFA
gccagagccggggtgtgcagacgg

SEQ ID NO: 3981 - DNA, 24 bp, Artificial Sequence
  Description of Artificial Sequence: Synthetic oligonucleotide
  Category: MG32 HEK targeting guides
  Description: MG28-1, MG28-1, MG29-1, MG30-1, MG30-1, MG31-1, MG32-1 guide sequence 3 for targeting VEGFA
ggaggtcagaaatagggggtccag

SEQ ID NO: 3982 - DNA, 24 bp, Artificial Sequence
  Description of Artificial Sequence: Synthetic oligonucleotide
  Category: MG32 HEK targeting guides
  Description: MG28-1, MG28-1, MG30-1, MG30-1, MG32-1 guide sequence 1 for targeting Albumin
gtatttgtgaagtcttacaaggtt

SEQ ID NO: 3983 - DNA, 24 bp, Artificial Sequence
  Description of Artificial Sequence: Synthetic oligonucleotide
  Category: MG32 HEK targeting guides
  Description: MG28-1, MG28-1, MG29-1, MG30-1, MG30-1, MG31-1, MG32-1 guide sequence 2 for targeting Albumin
tgaagtcttacaaggttatcttat

SEQ ID NO: 3984 - DNA, 24 bp, Artificial Sequence
  Description of Artificial Sequence: Synthetic oligonucleotide
  Category: MG32 HEK targeting guides
  Description: MG28-1, MG30-1, MG32-1 guide sequence 3 for targeting Albumin
ttaataagataaccttgtaagact

SEQ ID NO: 3985 - DNA, 44 bp, Artificial Sequence
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 1
uaauuucuacucuuguagaugaaagggggtggggggagtttgct

SEQ ID NO: 3986 - DNA, 44 bp, Artificial Sequence; identical to SEQ ID NO: 3985
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 2

SEQ ID NO: 3987 - DNA, 44 bp, Artificial Sequence; identical to SEQ ID NO: 3985
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 3

SEQ ID NO: 3988 - DNA, 44 bp, Artificial Sequence; identical to SEQ ID NO: 3985
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 4

SEQ ID NO: 3989 - DNA, 44 bp, Artificial Sequence; identical to SEQ ID NO: 3985
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 5

SEQ ID NO: 3990 - DNA, 45 bp, Artificial Sequence
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 6
cuaauuucuacucuuguagaugaaagggggtggggggagtttgct

SEQ ID NO: 3991 - DNA, 45 bp, Artificial Sequence; identical to SEQ ID NO: 3990
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 7

SEQ ID NO: 3992 - DNA, 44 bp, Artificial Sequence; identical to SEQ ID NO: 3985
  Description of Artificial Sequence: Synthetic oligonucleotide
  Description of Combined DNA/RNA Molecule: Synthetic oligonucleotide
  Category: MG29-1 guide modifications
  Description: MG29-1 guide modification test no. 8

SEQ ID NO: 3993 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-1
gtatagcatggtcgagcaggca

SEQ ID NO: 3994 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-2
ccgatcgttacaggaaaatctg

SEQ ID NO: 3995 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-3
aatttattacggtctcataggg

SEQ ID NO: 3996 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-4
ttacggtctcatagggcctgcc

SEQ ID NO: 3997 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-5
cctgtaacgatcgggaactggc

SEQ ID NO: 3998 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-7
agtatagcatggtcgagcaggc

SEQ ID NO: 3999 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-8
ctgtaacgatcgggaactggca

SEQ ID NO: 4000 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-9
gatacagttgaatttattacgg

SEQ ID NO: 4001 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-10
tagtatagcatggtcgagcagg

SEQ ID NO: 4002 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-11
catctgagaacccttaggtggt

SEQ ID NO: 4003 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-12
agtgtagcagagaggaaccatt

SEQ ID NO: 4004 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-13
ctagtaatggaagcctggtatt

SEQ ID NO: 4005 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-14
ggtatctttgatgacaataatg

SEQ ID NO: 4006 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-15
tctagtaatggaagcctggtat

SEQ ID NO: 4007 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-16
tagtaatggaagcctggtattt

SEQ ID NO: 4008 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-17
gtatctttgatgacaataatgg

SEQ ID NO: 4009 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-18
aagattgatgaagacaactaac

SEQ ID NO: 4010 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-19
ctctctgctacactcaaagtta

SEQ ID NO: 4011 - DNA, 22 bp, Artificial Sequence
  Description of Artificial Sequence: Synthetic oligonucleotide
  Category: MG29-1 spacer used in sgRNA to target mouse albumin intron 1
  Description: mAlb29-1-20
aaacccgttaagtgtttatatc

SEQ ID NO: 4012 - DNA, 4 bp, Artificial Sequence
  Description of Artificial Sequence: Synthetic oligonucleotide
  Category: MG29-1 PAM when targeting mouse albumin intron 1
  Description: mAlb29-1-1 PAM
ttta

SEQ ID NO: 4013 - DNA, 4 bp, Artificial Sequence
  Description of Artificial Sequence: Synthetic oligonucleotide
  Category: MG29-1 PAM when targeting mouse albumin intron 1
  Description: mAlb29-1-2 PAM
gttc

SEQ ID NO: 4014 - DNA, 4 bp, Artificial Sequence
  Description of Artificial Sequence: Synthetic oligonucleotide
  Category: MG29-1 PAM when targeting mouse albumin intron 1
  Description: mAlb29-1-3 PAM
gttg

SEQ ID NO: 4015 - DNA, 4 bp, Artificial Sequence
  Description of Artificial Sequence: Synthetic oligonucleotide
  Category: MG29-1 PAM when targeting mouse albumin intron 1
  Description: mAlb29-1-4 PAM
ttta

SEQ ID NO: 4016 - DNA, 4 bp, Artificial Sequence
  Description of Artificial Sequence: Synthetic oligonucleotide
  Category: MG29-1 PAM when targeting mouse albumin intron 1
  Description: mAlb29-1-5 PAM
tttt

SEQ ID NO: 4017 - DNA, 4 bp, Artificial Sequence
  Description of Artificial Sequence: Synthetic oligonucleotide
  Category: MG29-1 PAM when targeting mouse albumin intron 1
  Description: mAlb29-1-7 PAM
tttt

SEQ ID NO: 4018 - DNA, 4 bp, Artificial Sequence
  Description of Artificial Sequence: Synthetic oligonucleotide
  Category: MG29-1 PAM when targeting mouse albumin intron 1
  Description: mAlb29-1-8 PAM
tttc

SEQ ID NO: 4019 - DNA, 4 bp, Artificial Sequence
  Description of Artificial Sequence: Synthetic oligonucleotide
  Category: MG29-1 PAM when targeting mouse albumin intron 1
  Description: mAlb29-1-9 PAM
gttg

SEQ ID NO: 4020 - DNA, 4 bp, Artificial Sequence
  Description of Artificial Sequence: Synthetic oligonucleotide
  Category: MG29-1 PAM when targeting mouse albumin intron 1
  Description: mAlb29-1-10 PAM
tttt

SEQ ID NO: 4021 - DNA, 4 bp, Artificial Sequence
  Description of Artificial Sequence: Synthetic oligonucleotide
  Category: MG29-1 PAM when targeting mouse albumin intron 1
  Description: mAlb29-1-11 PAM
tttg

SEQ ID NO: 4022 - DNA, 4 bp, Artificial Sequence
  Description of Artificial Sequence: Synthetic oligonucleotide
  Category: MG29-1 PAM when targeting mouse albumin intron 1
  Description: mAlb29-1-12 PAM
tttg

SEQ ID NO: 4023 - DNA, 4 bp, Artificial Sequence
  Description of Artificial Sequence: Synthetic oligonucleotide
  Category: MG29-1 PAM when targeting mouse albumin intron 1
  Description: mAlb29-1-13 PAM
tttt

SEQ ID NO: 4024 - DNA, 4 bp, Artificial Sequence
  Description of Artificial Sequence: Synthetic oligonucleotide
  Category: MG29-1 PAM when targeting mouse albumin intron 1
  Description: mAlb29-1-14 PAM
tttt

SEQ ID NO: 4025 - DNA, 4 bp, Artificial Sequence
  Description of Artificial Sequence: Synthetic oligonucleotide
  Category: MG29-1 PAM when targeting mouse albumin intron 1
  Description: mAlb29-1-15 PAM
tttt

SEQ ID NO: 4026 - DNA, 4 bp, Artificial Sequence
  Description of Artificial Sequence: Synthetic oligonucleotide
  Category: MG29-1 PAM when targeting mouse albumin intron 1
  Description: mAlb29-1-16 PAM
tttc

SEQ ID NO: 4027 - DNA, 4 bp, Artificial Sequence
  Description of Artificial Sequence: Synthetic oligonucleotide
  Category: MG29-1 PAM when targeting mouse albumin intron 1
  Description: mAlb29-1-17 PAM
tttg

SEQ ID NO: 4028 - DNA, 4 bp, Artificial Sequence
  Description of Artificial Sequence: Synthetic oligonucleotide
  Category: MG29-1 PAM when targeting mouse albumin intron 1
  Description: mAlb29-1-18 PAM
ttta

SEQ ID NO: 4029 - DNA, 4 bp, Artificial Sequence
  Description of Artificial Sequence: Synthetic oligonucleotide
  Category: MG29-1 PAM when targeting mouse albumin intron 1
  Description: mAlb29-1-19 PAM
gttc

SEQ ID NO: 4030 - DNA, 4 bp, Artificial Sequence
  Description of Artificial Sequence: Synthetic oligonucleotide
  Category: MG29-1 PAM when targeting mouse albumin intron 1
  Description: mAlb29-1-20 PAM
ttta

SEQ ID NO: 4031 - DNA, 18 bp, Artificial Sequence
  Description of Artificial Sequence: Synthetic oligonucleotide
  Category: Primers
  Description: mAlb90F
ctcctcttcgtctccggc

SEQ ID NO: 4032 - DNA, 19 bp, Artificial Sequence
  Description of Artificial Sequence: Synthetic oligonucleotide
  Category: Primers
  Description: mAlb1073R
ctgccacattgctcagcac

SEQ ID NO: 4033 - DNA, 22 bp, Artificial Sequence
  Description of Artificial Sequence: Synthetic oligonucleotide
  Category: MG29-1 spacer used in sgRNA to target human albumin intron 1
  Description: hAlb_g63
gtaaactctgcatctttaaaga

SEQ ID NO: 4034 - DNA, 22 bp, Artificial Sequence
  Description of Artificial Sequence: Synthetic oligonucleotide
  Category: MG29-1 spacer used in sgRNA to target human albumin intron 1
  Description: hAlb_g59
tttcaaaatattgggctctgat

SEQ ID NO: 4035 - DNA, 22 bp, Artificial Sequence
  Description of Artificial Sequence: Synthetic oligonucleotide
  Category: MG29-1 spacer used in sgRNA to target human albumin intron 1
  Description: hAlb_g58
agtaaactctgcatctttaaag

SEQ ID NO: 4036 - DNA, 22 bp, Artificial Sequence
  Description of Artificial Sequence: Synthetic oligonucleotide
  Category: MG29-1 spacer used in sgRNA to target human albumin intron 1
  Description: hAlb_g56
aagatgcagagtttactaaaac

SEQ ID NO: 4037 - DNA, 22 bp, Artificial Sequence
  Description of Artificial Sequence: Synthetic oligonucleotide
  Category: MG29-1 spacer used in sgRNA to target human albumin intron 1
  Description: hAlb_g72
aaaatattgggctctgattcct

SEQ ID NO: 4038 - DNA, 22 bp, Artificial Sequence
  Description of Artificial Sequence: Synthetic oligonucleotide
  Category: MG29-1 spacer used in sgRNA to target human albumin intron 1
  Description: hAlb_g70
aaataaagcatagtgcaatgga

SEQ ID NO: 4039 - DNA, 22 bp, Artificial Sequence
  Description of Artificial Sequence: Synthetic oligonucleotide
  Category: MG29-1 spacer used in sgRNA to target human albumin intron 1
  Description: hAlb_g74
aataaagcatagtgcaatggat

SEQ ID NO: 4040 - DNA, 22 bp, Artificial Sequence
  Description of Artificial Sequence: Synthetic oligonucleotide
  Category: MG29-1 spacer used in sgRNA to target human albumin intron 1
  Description: hAlb_g83
tgagatcaacagcacaggtttt

SEQ ID NO: 4041 - DNA, 22 bp, Artificial Sequence
  Description of Artificial Sequence: Synthetic oligonucleotide
  Category: MG29-1 spacer used in sgRNA to target human albumin intron 1
  Description: hAlb_g85
tgtaggaatcagagcccaatat

SEQ ID NO: 4042 - DNA, 22 bp, Artificial Sequence
  Description of Artificial Sequence: Synthetic oligonucleotide
  Category: MG29-1 spacer used in sgRNA to target human albumin intron 1
  Description: hAlb_g89
ctgtaggaatcagagcccaata

SEQ ID NO: 4043 - DNA, 22 bp, Artificial Sequence
  Description of Artificial Sequence: Synthetic oligonucleotide
  Category: MG29-1 spacer used in sgRNA to target human albumin intron 1
  Description: hAlb_g88
tctgtaggaatcagagcccaat

SEQ ID NO: 4044 - DNA, 22 bp, Artificial Sequence
  Description of Artificial Sequence: Synthetic oligonucleotide
  Category: MG29-1 spacer used in sgRNA to target human albumin intron 1
  Description: hAlb_g77
gtgactgtaattttcttttgcg

SEQ ID NO: 4045 - DNA, 22 bp, Artificial Sequence
  Description of Artificial Sequence: Synthetic oligonucleotide
  Category: MG29-1 spacer used in sgRNA to target human albumin intron 1
  Description: hAlb_g69
cttttgcgcactaaggaaagtg

SEQ ID NO: 4046 - DNA, 22 bp, Artificial Sequence
  Description of Artificial Sequence: Synthetic oligonucleotide
  Category: MG29-1 spacer used in sgRNA to target human albumin intron 1
  Description: hAlb_g66
tgaagtcttacaaggttatctt

SEQ ID NO: 4047 - DNA, 22 bp, Artificial Sequence
  Description of Artificial Sequence: Synthetic oligonucleotide
  Category: MG29-1 spacer used in sgRNA to target human albumin intron 1
  Description: hAlb_g75
agtgtctatcaacagcaaccaa

SEQ ID NO: 4048 - DNA, 22 bp, Artificial Sequence
  Description of Artificial Sequence: Synthetic oligonucleotide
  Category: MG29-1 spacer used in sgRNA to target human albumin intron 1
  Description: hAlb_g79
cttagtgcgcaaaagaaaatta

SEQ ID NO: 4049 - DNA, 22 bp, Artificial Sequence
  Description of Artificial Sequence: Synthetic oligonucleotide
  Category: MG29-1 spacer used in sgRNA to target human albumin intron 1
  Description: hAlb_g82
tagccttatattcaaacttaga

SEQ ID NO: 4050 - DNA, 22 bp, Artificial Sequence
  Description of Artificial Sequence: Synthetic oligonucleotide
  Category: MG29-1 spacer used in sgRNA to target human albumin intron 1
  Description: hAlb_g80
ggatagttatgaattcaatctt

SEQ ID NO: 4051 - DNA, 22 bp, Artificial Sequence
  Description of Artificial Sequence: Synthetic oligonucleotide
  Category: MG29-1 spacer used in sgRNA to target human albumin intron 1
  Description: hAlb_g84
cactttccttagtgcgcaaaag

SEQ ID NO: 4052 - DNA, 22 bp, Artificial Sequence
  Description of Artificial Sequence: Synthetic oligonucleotide
  Category: MG29-1 spacer used in sgRNA to target human albumin intron 1
  Description: hAlb_g81
gtatttgtgaagtcttacaagg

SEQ ID NO: 4053 - DNA, 22 bp, Artificial Sequence
  Description of Artificial Sequence: Synthetic oligonucleotide
  Category: MG29-1 spacer used in sgRNA to target human albumin intron 1
  Description: hAlb_g90
gtgtctatcaacagcaaccaag

SEQ ID NO: 4054 - DNA, 22 bp, Artificial Sequence
  Description of Artificial Sequence: Synthetic oligonucleotide
  Category: MG29-1 spacer used in sgRNA to target human albumin intron 1
  Description: hAlb_g87
cgcactaaggaaagtgcaaagt

SEQ ID NO: 4055 - DNA, 22 bp, Artificial Sequence
  Description of Artificial Sequence: Synthetic oligonucleotide
  Category: MG29-1 spacer used in sgRNA to target human albumin intron 1
  Description: hAlb_g86
gcgcactaaggaaagtgcaaag

SEQ ID NO: 4056 - DNA, 4 bp, Artificial Sequence
  Description of Artificial Sequence: Synthetic oligonucleotide
  Category: MG29-1 PAM when targeting human albumin intron 1
  Description: hAlb_g63 PAM
ttta

SEQ ID NO: 4057 - DNA, 4 bp, Artificial Sequence
  Description of Artificial Sequence: Synthetic oligonucleotide
  Category: MG29-1 PAM when targeting human albumin intron 1
  Description: hAlb_g59 PAM
tttg

SEQ ID NO: 4058 - DNA, 4 bp, Artificial Sequence
  Description of Artificial Sequence: Synthetic oligonucleotide
  Category: MG29-1 PAM when targeting human albumin intron 1
  Description: hAlb_g58 PAM
tttt

SEQ ID NO: 4059 - DNA, 4 bp, Artificial Sequence
  Description of Artificial Sequence: Synthetic oligonucleotide
  Category: MG29-1 PAM when targeting human albumin intron 1
  Description: hAlb_g56 PAM
ttta

SEQ ID NO: 4060 - DNA, 4 bp, Artificial Sequence
  Description of Artificial Sequence: Synthetic oligonucleotide
  Category: MG29-1 PAM when targeting human albumin intron 1
  Description: hAlb_g72 PAM
tttc

SEQ ID NO: 4061 - DNA, 4 bp, Artificial Sequence
  Description of Artificial Sequence: Synthetic oligonucleotide
  Category: MG29-1 PAM when targeting human albumin intron 1
  Description: hAlb_g70 PAM
tttt

SEQ ID NO: 4062 - DNA, 4 bp, Artificial Sequence
  Description of Artificial Sequence: Synthetic oligonucleotide
  Category: MG29-1 PAM when targeting human albumin intron 1
  Description: hAlb_g74 PAM
ttta

SEQ ID NO: 4063 - DNA, 4 bp, Artificial Sequence
  Description of Artificial Sequence: Synthetic oligonucleotide
  Category: MG29-1 PAM when targeting human albumin intron 1
  Description: hAlb_g83 PAM
ttta

SEQ ID NO: 4064 - DNA, 4 bp, Artificial Sequence
  Description of Artificial Sequence: Synthetic oligonucleotide
  Category: MG29-1 PAM when targeting human albumin intron 1
  Description: hAlb_g85 PAM
tttc

SEQ ID NO: 4065 - DNA, 4 bp, Artificial Sequence
  Description of Artificial Sequence: Synthetic oligonucleotide
  Category: MG29-1 PAM when targeting human albumin intron 1
  Description: hAlb_g89 PAM
tttt

SEQ ID NO: 4066 - DNA, 4 bp, Artificial Sequence
  Description of Artificial Sequence: Synthetic oligonucleotide
  Category: MG29-1 PAM when targeting human albumin intron 1
  Description: hAlb_g88 PAM
tttt

SEQ ID NO: 4067 - DNA, 4 bp, Artificial Sequence
  Description of Artificial Sequence: Synthetic oligonucleotide
  Category: MG29-1 PAM when targeting human albumin intron 1
  Description: hAlb_g77 PAM
ttta

SEQ ID NO: 4068 - DNA, 4 bp, Artificial Sequence
  Description of Artificial Sequence: Synthetic oligonucleotide
  Category: MG29-1 PAM when targeting human albumin intron 1
  Description: hAlb_g69 PAM
tttt

SEQ ID NO: 4069 - DNA, 4 bp, Artificial Sequence
  Description of Artificial Sequence: Synthetic oligonucleotide
  Category: MG29-1 PAM when targeting human albumin intron 1
  Description: hAlb_g66 PAM
tttg

SEQ ID NO: 4070 - DNA, 4 bp, Artificial Sequence
  Description of Artificial Sequence: Synthetic oligonucleotide
  Category: MG29-1 PAM when targeting human albumin intron 1
  Description: hAlb_g75 PAM
tttt

SEQ ID NO: 4071 - DNA, 4 bp, Artificial Sequence
  Description of Artificial Sequence: Synthetic oligonucleotide
  Category: MG29-1 PAM when targeting human albumin intron 1
  Description: hAlb_g79 PAM
tttc

SEQ ID NO: 4072 - DNA, 4 bp, Artificial Sequence
  Description of Artificial Sequence: Synthetic oligonucleotide
  Category: MG29-1 PAM when targeting human albumin intron 1
  Description: hAlb_g82 PAM
ttta

SEQ ID NO: 4073 - DNA, 4 bp, Artificial Sequence
  Description of Artificial Sequence: Synthetic oligonucleotide
  Category: MG29-1 PAM when targeting human albumin intron 1
  Description: hAlb_g80 PAM
tttg

SEQ ID NO: 4074 - DNA, 4 bp, Artificial Sequence
  Description of Artificial Sequence: Synthetic oligonucleotide
  Category: MG29-1 PAM when targeting human albumin intron 1
  Description: hAlb_g84 PAM
tttg

SEQ ID NO: 4075 - DNA, 4 bp, Artificial Sequence
  Description of Artificial Sequence: Synthetic oligonucleotide
  Category: MG29-1 PAM when targeting human albumin intron 1
  Description: hAlb_g81 PAM
tttt

SEQ ID NO: 4076 - DNA, 4 bp, Artificial Sequence
  Description of Artificial Sequence: Synthetic oligonucleotide
  Category: MG29-1 PAM when targeting human albumin intron 1
  Description: hAlb_g90 PAM
ttta

SEQ ID NO: 4077 - DNA, 4 bp, Artificial Sequence
  Description of Artificial Sequence: Synthetic oligonucleotide
  Category: MG29-1 PAM when targeting human albumin intron 1
  Description: hAlb_g87 PAM
tttg

SEQ ID NO: 4078 - DNA, 4 bp, Artificial Sequence
  Description of Artificial Sequence: Synthetic oligonucleotide
  Category: MG29-1 PAM when targeting human albumin intron 1
  Description: hAlb_g86 PAM
tttt

SEQ ID NO: 4079 - DNA, 22 bp, Artificial Sequence
  Description of Artificial Sequence: Synthetic oligonucleotide
  Category: Primers
  Description: hAlb 11F
tcttctgtcaaccccacacgcc

SEQ ID NO: 4080 - DNA, 20 bp, Artificial Sequence
  Description of Artificial Sequence: Synthetic oligonucleotide
  Category: Primers
  Description: hAlb834R
cttgtctgggcaagggaaga

SEQ ID NO: 4081 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-1
ccccagacctgtaatagtcata

SEQ ID NO: 4082 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-2
aggacagagagtcagcatgcca

SEQ ID NO: 4083 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-3
ggagacaacagtggacttgctg

SEQ ID NO: 4084 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-4
ccctaccctgccacaatgttgc

SEQ ID NO: 4085 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-5
cttacctagaaaatgcttggat

SEQ ID NO: 4086 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-6
acagatcgatatcagcaacgtt

SEQ ID NO: 4087 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-7
cgaagcatccgtggatagagct

SEQ ID NO: 4088 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-8
ttgggctacctcctcaatagaa

SEQ ID NO: 4089 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-9
aagctgccaccacaactcaggt

SEQ ID NO: 4090 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-10
tggtggcagcttgaacctgttc

SEQ ID NO: 4091 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-11
cgcacgtcatcaatgcggttgc

SEQ ID NO: 4092 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-12
cccaggtaaggggtgtccacag

SEQ ID NO: 4093 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-13
catccagcgaagtgcctctggg

SEQ ID NO: 4094 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-14
aaattccagatggaagctctat

SEQ ID NO: 4095 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-15
tgactgtggacaccccttacct

SEQ ID NO: 4096 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-16
attacagcctgtcagaccatgg

SEQ ID NO: 4097 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-17
gagacaacagtggacttgctga

SEQ ID NO: 4098 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-18
caacaataggcagtgatgtcaa

SEQ ID NO: 4099 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-19
cctcgactggtctgcatcagtg

SEQ ID NO: 4100 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-20
ataatcactgatgcagaccagt

SEQ ID NO: 4101 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-21
tcagctaacgtctcctgatcat

SEQ ID NO: 4102 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-22
ctgatatcgatctgtcaacttc

SEQ ID NO: 4103 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-23
taaagggcattttgagaggttt

SEQ ID NO: 4104 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-24
aatagcaaagtttcttacctag

SEQ ID NO: 4105 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-25
ggacagagagtcagcatgccaa

SEQ ID NO: 4106 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-26
tccatttcattacagcctgtca

SEQ ID NO: 4107 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-27
agtctgtgagatcatactgacc

SEQ ID NO: 4108 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-28
tagatgtacagttgcatccagc

SEQ ID NO: 4109 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-29
ccttaggagaaaatgccaaatc

SEQ ID NO: 4110 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-30
ctcctaagggaaattttggaga

SEQ ID NO: 4111 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-31
gctgataacatccaagcatttt

SEQ ID NO: 4112 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-32
aaatagcaaagtttcttaccta

SEQ ID NO: 4113 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-33
taggacagagagtcagcatgcc

SEQ ID NO: 4114 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-34
gggctactgccatgcagtgcat

SEQ ID NO: 4115 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-35
tctccaaaatttcccttaggag

SEQ ID NO: 4116 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-36
aattccagatggaagctctatc

SEQ ID NO: 4117 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-37
tcctaagggaaattttggagac

SEQ ID NO: 4118 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-38
ttacctagaaaatgcttggatg

SEQ ID NO: 4119 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-39
caaggccatatttgtgactgtg

SEQ ID NO: 4120 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-40
ctccatttcattacagcctgtc

SEQ ID NO: 4121 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-41
gcattttctcctaagggaaatt

SEQ ID NO: 4122 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-42
ttacctcgcacagtggccagct

SEQ ID NO: 4123 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-43
tctctcttttcttacctcgcac

SEQ ID NO: 4124 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-44
cttacctcgcacagtggccagc

SEQ ID NO: 4125 - DNA, 22 bp, Artificial Sequence
  Description of Artificial Sequence: Synthetic oligonucleotide
  Category: MG29-1 spacer used in sgRNA to target mouse hao-1 exons 1 to 4
  Description: mH29-45
aaaccaatgatttggcattttc

SEQ ID NO: 4126 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-1 PAM
tttg

SEQ ID NO: 4127 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-2 PAM
tttt

SEQ ID NO: 4128 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-3 PAM
tttt

SEQ ID NO: 4129 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-4 PAM
gttg

SEQ ID NO: 4130 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-5 PAM
gttt

SEQ ID NO: 4131 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-6 PAM
gttg

SEQ ID NO: 4132 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-7 PAM
gttg

SEQ ID NO: 4133 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-8 PAM
gttc

SEQ ID NO: 4134 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-9 PAM
gttc

SEQ ID NO: 4135 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-10 PAM
gttg

SEQ ID NO: 4136 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-11 PAM
gttc

SEQ ID NO: 4137 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-12 PAM
gttg

SEQ ID NO: 4138 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-13 PAM
gttg

SEQ ID NO: 4139 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-14 PAM
tttt

SEQ ID NO: 4140 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-15 PAM
tttg

SEQ ID NO: 4141 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-16 PAM
tttc

SEQ ID NO: 4142 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-17PAM
tttg

SEQ ID NO: 4143 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-18 PAM
ttta

SEQ ID NO: 4144 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-19 PAM
gttg

SEQ ID NO: 4145 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-20 PAM
gttc

SEQ ID NO: 4146 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-21 PAM
gtta

SEQ ID NO: 4147 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-22 PAM
gttg

SEQ ID NO: 4148 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-23 PAM
gttg

SEQ ID NO: 4149 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-24 PAM
ttta

SEQ ID NO: 4150 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-25 PAM
ttta

SEQ ID NO: 4151 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-26 PAM
tttc

SEQ ID NO: 4152 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-27 PAM
tttg

SEQ ID NO: 4153 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-28 PAM
tttg

SEQ ID NO: 4154 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-29 PAM
tttc

SEQ ID NO: 4155 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-30 PAM
tttt

SEQ ID NO: 4156 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-31 PAM
gtta

SEQ ID NO: 4157 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-32 PAM
gttt

SEQ ID NO: 4158 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-33 PAM
gttt

SEQ ID NO: 4159 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-34 PAM
gttg

SEQ ID NO: 4160 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-35 PAM
gttg

SEQ ID NO: 4161 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-36 PAM
ttta

SEQ ID NO: 4162 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-37 PAM
tttc

SEQ ID NO: 4163 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-38 PAM
tttc

SEQ ID NO: 4164 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-39 PAM
gtta

SEQ ID NO: 4165 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-40 PAM
tttt

SEQ ID NO: 4166 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-41 PAM
tttg

SEQ ID NO: 4167 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-42 PAM
tttc

SEQ ID NO: 4168 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-43 PAM
tttg

SEQ ID NO: 4169 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-44 PAM
tttt

SEQ ID NO: 4170 - DNA, 4 bp, Artificial Sequence
  Description of Artificial Sequence: Synthetic oligonucleotide
  Category: MG29-1 PAM used in sgRNA to target mouse hao-1 exons 1 to 4
  Description: mH29-45 PAM
tttg

SEQ ID NO: 4171 - DNA, 20 bp, Artificial Sequence
  Description of Artificial Sequence: Synthetic oligonucleotide
  Category: Primers
  Description: PCR_mHE1_F_+233
gtgaccaaccctacccgttt

SEQ ID NO: 4172 - DNA, 20 bp, Artificial Sequence
  Description of Artificial Sequence: Synthetic oligonucleotide
  Category: Primers
  Description: PCR_mHE1_R_-553
gcaagcacctactgtctcgt

SEQ ID NO: 4173 - DNA, 20 bp, Artificial Sequence
  Description of Artificial Sequence: Synthetic oligonucleotide
  Category: Primers
  Description: HAO1_E2_F5721
caacgaaggttccctccagg

SEQ ID NO: 4174 - DNA, 20 bp, Artificial Sequence
  Description of Artificial Sequence: Synthetic oligonucleotide
  Category: Primers
  Description: HAO1_E2_R6271
ggaagggtgttcgagaagga

SEQ ID NO: 4175 - DNA, 20 bp, Artificial Sequence
  Description of Artificial Sequence: Synthetic oligonucleotide
  Category: Primers
  Description: HAO1_E3_F23198
tgccctagacaagctgacac

SEQ ID NO: 4176 - DNA, 20 bp, Artificial Sequence
  Description of Artificial Sequence: Synthetic oligonucleotide
  Category: Primers
  Description: HAO1_E3_R23879
cagattctggaagtggccca

SEQ ID NO: 4177 - DNA, 20 bp, Artificial Sequence
  Description of Artificial Sequence: Synthetic oligonucleotide
  Category: Primers
  Description: HAO1_E4_F31087
cctgtaggtggctgagtacg

SEQ ID NO: 4178 - DNA, 20 bp, Artificial Sequence
  Description of Artificial Sequence: Synthetic oligonucleotide
  Category: Primers
  Description: HAO1_E4_R31650
aggtttggttcccctcacct

SEQ ID NO: 4179 - DNA, 24 bp, Artificial Sequence
  Description of Artificial Sequence: Synthetic oligonucleotide
  Category: Primers
  Description: Seq_mHE1_F_+139
gtctaggcatacaatgtttgctca

SEQ ID NO: 4180 - DNA, 23 bp, Artificial Sequence
  Description of Artificial Sequence: Synthetic oligonucleotide
  Category: Primers
  Description: 5938F Seq_HAO1_E2
ctatgcaaggaaaagatttggcc

SEQ ID NO: 4181 - DNA, 23 bp, Artificial Sequence
  Description of Artificial Sequence: Synthetic oligonucleotide
  Category: Primers
  Description: HAO1_E3_F23476
tcttcccccttgaatgaaacact

SEQ ID NO: 4182 - DNA, 20 bp, Artificial Sequence
  Description of Artificial Sequence: Synthetic oligonucleotide
  Category: Primers
  Description: HAO1_E3_R23879
cagattctggaagtggccca

SEQ ID NO: 4183 - DNA, 20 bp, Artificial Sequence
  Description of Artificial Sequence: Synthetic oligonucleotide
  Category: Primers
  Description: HAO1_E4_R31650
aggtttggttcccctcacct

SEQ ID NO: 4184 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-1
gcatgttgttcataatcattga

SEQ ID NO: 4185 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-2
gaagtactgatttagcatgttg

SEQ ID NO: 4186 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-3
tatcaatgattatgaacaacat

SEQ ID NO: 4187 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-4
ccccagacctgtaatagtcata

SEQ ID NO: 4188 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-5
ttcatcatttgccccagacctg

SEQ ID NO: 4189 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-6
ttacctggaaaatgctgcaata

SEQ ID NO: 4190 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-7
cttacctggaaaatgctgcaat

SEQ ID NO: 4191 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-8
gctgataatattgcagcatttt

SEQ ID NO: 4192 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-9
aaaaataaattttcttacctgg

SEQ ID NO: 4193 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-10
aaaaaataaattttcttacctg

SEQ ID NO: 4194 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-11
attttattttttaattctagat

SEQ ID NO: 4195 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-12
ttttattttttaattctagatg

SEQ ID NO: 4196 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-13
attttttaattctagatggaag

SEQ ID NO: 4197 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-14
ttttttaattctagatggaagc

SEQ ID NO: 4198 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-15
ttaattctagatggaagctgta

SEQ ID NO: 4199 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-16
taattctagatggaagctgtat

SEQ ID NO: 4200 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-17
aattctagatggaagctgtatc

SEQ ID NO: 4201 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-18
attctagatggaagctgtatcc

SEQ ID NO: 4202 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-19
agcaacattccggagcatcctt

SEQ ID NO: 4203 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-20
aggacagagggtcagcatgcca

SEQ ID NO: 4204 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-21
ggacagagggtcagcatgccaa

SEQ ID NO: 4205 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-22
tttctcagcctgtcagtccctg

SEQ ID NO: 4206 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-23
tcagcctgtcagtccctgggaa

SEQ ID NO: 4207 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-24
tgacagtggacacaccttacct

SEQ ID NO: 4208 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-25
aatctgttacgcacatcatcca

SEQ ID NO: 4209 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-26
atgcatttcttattttaggatg

SEQ ID NO: 4210 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-27
tgcatttcttattttaggatga

SEQ ID NO: 4211 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-28
ttattttaggatgaaaaatttt

SEQ ID NO: 4212 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-29
aggatgaaaaattttgaaacca

SEQ ID NO: 4213 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-30
ggatgaaaaattttgaaaccag

SEQ ID NO: 4214 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-31
ctcaggagaaaatgataaagta

SEQ ID NO: 4215 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-32
cctcaggagaaaatgataaagt

SEQ ID NO: 4216 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-33
gaaaccagtactttatcatttt

SEQ ID NO: 4217 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-34
aaaccagtactttatcattttc

SEQ ID NO: 4218 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-35
tcattttctcctgaggaaaatt

SEQ ID NO: 4219 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-36
ctcctgaggaaaattttggaga

SEQ ID NO: 4220 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-37
tcctgaggaaaattttggagac

SEQ ID NO: 4221 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-38
gccacatatgcagcaagtccac

SEQ ID NO: 4222 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-39
ggagacgacagtggacttgctg

SEQ ID NO: 4223 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-40
gagacgacagtggacttgctgc

SEQ ID NO: 4224 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-41
atatcttcccagctgatagatg

SEQ ID NO: 4225 - DNA, 22 bp, Artificial Sequence
  Description of Artificial Sequence: Synthetic oligonucleotide
  Category: MG29-1 spacer sequences identified in exons 1 to 4 of the human hao-1 gene
  Description: hH29-42
caacaattggcaatgatgtcag

SEQ ID NO: 4226 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-1 PAM
ttta

SEQ ID NO: 4227 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-2 PAM
tttg

SEQ ID NO: 4228 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-3 PAM
tttg

SEQ ID NO: 4229 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-4 PAM
tttg

SEQ ID NO: 4230 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-5 PAM
tttc

SEQ ID NO: 4231 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-6 PAM
tttc

SEQ ID NO: 4232 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-7 PAM
tttt

SEQ ID NO: 4233 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-8 PAM
tttg

SEQ ID NO: 4234 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-9 PAM
ttta

SEQ ID NO: 4235 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-10 PAM
tttt

SEQ ID NO: 4236 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-11 PAM
tttt

SEQ ID NO: 4237 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-12 PAM
ttta

SEQ ID NO: 4238 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-13 PAM
tttt

SEQ ID NO: 4239 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-14 PAM
ttta

SEQ ID NO: 4240 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-15 PAM
tttt

SEQ ID NO: 4241 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-16 PAM
tttt

SEQ ID NO: 4242 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-17 PAM
tttt

SEQ ID NO: 4243 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-18 PAM
ttta

SEQ ID NO: 4244 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-19 PAM
tttc

SEQ ID NO: 4245 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-20 PAM
tttt

SEQ ID NO: 4246 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-21 PAM
ttta

SEQ ID NO: 4247 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-22 PAM
tttc

SEQ ID NO: 4248 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-23 PAM
tttc

SEQ ID NO: 4249 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-24 PAM
tttg

SEQ ID NO: 4250 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-25 PAM
tttg

SEQ ID NO: 4251 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-26 PAM
tttt

SEQ ID NO: 4252 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-27 PAM
ttta

SEQ ID NO: 4253 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-28 PAM
tttc

SEQ ID NO: 4254 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-29 PAM
tttt

SEQ ID NO: 4255 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-30 PAM
ttta

SEQ ID NO: 4256 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-31 PAM
tttc

SEQ ID NO: 4257 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-32 PAM
tttt

SEQ ID NO: 4258 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-33 PAM
tttt

SEQ ID NO: 4259 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-34 PAM
tttg

SEQ ID NO: 4260 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-35 PAM
ttta

SEQ ID NO: 4261 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-36 PAM
tttt

SEQ ID NO: 4262 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-37 PAM
tttc

SEQ ID NO: 4263 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-38 PAM
ttta

SEQ ID NO: 4264 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-39 PAM
tttt

SEQ ID NO: 4265 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-40 PAM
tttg

SEQ ID NO: 4266 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-41 PAM
tttg

SEQ ID NO: 4267 - DNA, 4 bp, Artificial Sequence
  Description of Artificial Sequence: Synthetic oligonucleotide
  Category: MG29-1 PAM sequences identified in exons 1 to 4 of the human hao-1 gene
  Description: hH29-42 PAM
tttg

SEQ ID NO: 4268 - DNA, 22 bp, Artificial Sequence
  Description of Artificial Sequence: Synthetic oligonucleotide
  Category: TRAC spacer
  Description: Guide 35 TRAC spacer
gagtctctcagctggtacacgg

SEQ ID NO: 4269 - DNA, 20 bp, Artificial Sequence
  Description of Artificial Sequence: Synthetic oligonucleotide
  Category: Primers
  Description: Primer F
tgctttgctgggcctttttc

SEQ ID NO: 4270 - DNA, 20 bp, Artificial Sequence
  Description of Artificial Sequence: Synthetic oligonucleotide
  Category: Primers
  Description: Primer R
acagtctgagcaaaggcagg

SEQ ID NO: 4271 - DNA, 20 bp, Artificial Sequence
  Description of Artificial Sequence: Synthetic oligonucleotide
  Category: Primers
  Description: Primer for Sanger sequencing
atcacgagcagctggtttct

SEQ ID NO: 4272 - RNA, 44 nt, Artificial Sequence
  Description of Artificial Sequence: Synthetic oligonucleotide
  Category: Chemically modified MG29-1 sgRNA
  Description: mAlb298-0
cuuaauuucuacuguuguagaucuguaacgaucgggaacuggca

SEQ ID NO: 4273 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-1

SEQ ID NO: 4274 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-2

SEQ ID NO: 4275 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-3

SEQ ID NO: 4276 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-4

SEQ ID NO: 4277 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-5

SEQ ID NO: 4278 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-6

SEQ ID NO: 4279 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-7

SEQ ID NO: 4280 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-8

SEQ ID NO: 4281 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-9

SEQ ID NO: 4282 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-10

SEQ ID NO: 4283 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-11

SEQ ID NO: 4284 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-12

SEQ ID NO: 4285 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-13

SEQ ID NO: 4286 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-14

SEQ ID NO: 4287 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-15

SEQ ID NO: 4288 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-16

SEQ ID NO: 4289 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-17

SEQ ID NO: 4290 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-18

SEQ ID NO: 4291 - RNA, 48 nt, Artificial Sequence
  Description of Artificial Sequence: Synthetic oligonucleotide
  Category: Chemically modified MG29-1 sgRNA
  Description: mAlb298-19
guagcuuaauuucuacuguuguagaucuguaacgaucgggaacuggca

SEQ ID NO: 4292 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-20

SEQ ID NO: 4293 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-21

SEQ ID NO: 4294 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-22

SEQ ID NO: 4295 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-23

SEQ ID NO: 4296 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-24

SEQ ID NO: 4297 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-25

SEQ ID NO: 4298 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-26

SEQ ID NO: 4299 - RNA, 46 nt, Artificial Sequence
  Description of Artificial Sequence: Synthetic oligonucleotide
  Category: Chemically modified MG29-1 sgRNA
  Description: mAlb298-27
cuuuuaauuucuacuguuguagaucuguaacgaucgggaacuggca

SEQ ID NO: 4300 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-28

SEQ ID NO: 4301 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-29

SEQ ID NO: 4302 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-30

SEQ ID NO: 4303 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-31

SEQ ID NO: 4304 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-32

SEQ ID NO: 4305 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-33

SEQ ID NO: 4306 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-34

SEQ ID NO: 4307 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-35

SEQ ID NO: 4308 - RNA, 44 nt, Artificial Sequence; identical to SEQ ID NO: 4272
  Description of Artificial Sequence: Synthetic oligonucleotide
  Category: Chemically modified MG29-1 sgRNA
  Description: mAlb298-36

SEQ ID NO: 4309 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-37

SEQ ID NO: 4310 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-38

SEQ ID NO: 4311 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-39

SEQ ID NO: 4312 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-40

SEQ ID NO: 4313 - DNA, 46 bp, Artificial Sequence
  Description of Artificial Sequence: Synthetic oligonucleotide
  Description of Combined DNA/RNA Molecule: Synthetic oligonucleotide
  Category: Chemically modified MG29-1 sgRNA
  Description: mAlb298-41
cuuuuaauuucuacuguugtagatcuguaacgaucgggaacuggca

SEQ ID NO: 4314 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-42

SEQ ID NO: 4315 - RNA, 46 nt, Artificial Sequence; identical to SEQ ID NO: 4299
  Description of Artificial Sequence: Synthetic oligonucleotide
  Category: Chemically modified MG29-1 sgRNA
  Description: mAlb298-43

SEQ ID NO: 4316 - DNA, 22 bp, Artificial Sequence
  Description of Artificial Sequence: Synthetic oligonucleotide
  Category: MG29-1 TRAC Guides
  Description: MG29-1 Guide 1 Target Sequence
accgattttgattctcaaacaa

SEQ ID NO: 4317 - DNA, 22 bp, Artificial Sequence
  Description of Artificial Sequence: Synthetic oligonucleotide
  Category: MG29-1 TRAC Guides
  Description: MG29-1 Guide 2 Target Sequence
tgattctcaaacaaatgtgtca

SEQ ID NO: 4318 - DNA, 22 bp, Artificial Sequence
  Description of Artificial Sequence: Synthetic oligonucleotide
  Category: MG29-1 TRAC Guides
  Description: MG29-1 Guide 3 Target Sequence
gattctcaaacaaatgtgtcac

SEQ ID NO: 4319 - DNA, 22 bp, Artificial Sequence
  Description of Artificial Sequence: Synthetic oligonucleotide
  Category: MG29-1 TRAC Guides
  Description: MG29-1 Guide 4 Target Sequence
attctcaaacaaatgtgtcaca

SEQ ID NO: 4320 - DNA, 22 bp, Artificial Sequence
  Description of Artificial Sequence: Synthetic oligonucleotide
  Category: MG29-1 TRAC Guides
  Description: MG29-1 Guide 5 Target Sequence
tcaaacaaatgtgtcacaaagt

SEQ ID NO: 4321 - DNA, 22 bp, Artificial Sequence
  Description of Artificial Sequence: Synthetic oligonucleotide
  Category: MG29-1 TRAC Guides
  Description: MG29-1 Guide 6 Target Sequence
tgatgtgtatatcacagacaaa

SEQ ID NO: 4322 - DNA, 22 bp, Artificial Sequence
  Description of Artificial Sequence: Synthetic oligonucleotide
  Category: MG29-1 TRAC Guides
  Description: MG29-1 Guide 7 Target Sequence
aagagcaacagtgctgtggcct

SEQ ID NO: 4323 - DNA, 22 bp, Artificial Sequence
  Description of Artificial Sequence: Synthetic oligonucleotide
  Category: MG29-1 TRAC Guides
  Description: MG29-1 Guide 8 Target Sequence
gcatgtgcaaacgccttcaaca

SEQ ID NO: 4324 - DNA, 22 bp, Artificial Sequence
  Description of Artificial Sequence: Synthetic oligonucleotide
  Category: MG29-1 TRAC Guides
  Description: MG29-1 Guide 9 Target Sequence
catgtgcaaacgccttcaacaa

SEQ ID NO: 4325 - DNA, 22 bp, Artificial Sequence
  Description of Artificial Sequence: Synthetic oligonucleotide
  Category: MG29-1 TRAC Guides
  Description: MG29-1 Guide 10 Target Sequence
aacaacagcattattccagaag

SEQ ID NO: 4326 - DNA, 22 bp, Artificial Sequence
  Description of Artificial Sequence: Synthetic oligonucleotide
  Category: MG29-1 TRAC Guides
  Description: MG29-1 Guide 11 Target Sequence
ttccagaagacaccttcttccc

SEQ ID NO: 4327 - DNA, 22 bp, Artificial Sequence
  Description of Artificial Sequence: Synthetic oligonucleotide
  Category: MG29-1 TRAC Guides
  Description: MG29-1 Guide 12 Target Sequence
cagaagacaccttcttccccag

SEQ ID NO: 4328 - DNA, 22 bp, Artificial Sequence
  Description of Artificial Sequence: Synthetic oligonucleotide
  Category: MG29-1 TRAC Guides
  Description: MG29-1 Guide 13 Target Sequence
tggaataatgctgttgttgaag

SEQ ID NO: 4329 - DNA, 22 bp, Artificial Sequence
  Description of Artificial Sequence: Synthetic oligonucleotide
  Category: MG29-1 TRAC Guides
  Description: MG29-1 Guide 14 Target Sequence
ttgaaggcgtttgcacatgcaa

SEQ ID NO: 4330 - DNA, 22 bp, Artificial Sequence
  Description of Artificial Sequence: Synthetic oligonucleotide
  Category: MG29-1 TRAC Guides
  Description: MG29-1 Guide 15 Target Sequence
aaggcgtttgcacatgcaaagt

SEQ ID NO: 4331 - DNA, 22 bp, Artificial Sequence
  Description of Artificial Sequence: Synthetic oligonucleotide
  Category: MG29-1 TRAC Guides
  Description: MG29-1 Guide 16 Target Sequence
gcacatgcaaagtcagatttgt

SEQ ID NO: 4332 - DNA, 22 bp, Artificial Sequence
  Description of Artificial Sequence: Synthetic oligonucleotide
  Category: MG29-1 TRAC Guides
  Description: MG29-1 Guide 17 Target Sequence
cacatgcaaagtcagatttgtt

SEQ ID NO: 4333 - DNA, 22 bp, Artificial Sequence
  Description of Artificial Sequence: Synthetic oligonucleotide
  Category: MG29-1 TRAC Guides
  Description: MG29-1 Guide 18 Target Sequence
gttgctccaggccacagcactg

SEQ ID NO: 4334 - DNA, 22 bp, Artificial Sequence
  Description of Artificial Sequence: Synthetic oligonucleotide
  Category: MG29-1 TRAC Guides
  Description: MG29-1 Guide 19 Target Sequence
ttgctccaggccacagcactgt

SEQ ID NO: 4335 - DNA, 22 bp, Artificial Sequence
  Description of Artificial Sequence: Synthetic oligonucleotide
  Category: MG29-1 TRAC Guides
  Description: MG29-1 Guide 20 Target Sequence
ctccaggccacagcactgttgc

SEQ ID NO: 4336 - DNA, 22 bp, Artificial Sequence
  Description of Artificial Sequence: Synthetic oligonucleotide
  Category: MG29-1 TRAC Guides
  Description: MG29-1 Guide 21 Target Sequence
ctcttgaagtccatagacctca

SEQ ID NO: 4337 - DNA, 22 bp, Artificial Sequence
  Description of Artificial Sequence: Synthetic oligonucleotide
  Category: MG29-1 TRAC Guides
  Description: MG29-1 Guide 22 Target Sequence
aagtccatagacctcatgtcta

SEQ ID NO: 4338 - DNA, 22 bp, Artificial Sequence
  Description of Artificial Sequence: Synthetic oligonucleotide
  Category: MG29-1 TRAC Guides
  Description: MG29-1 Guide 23 Target Sequence
tgtctgtgatatacacatcaga

SEQ ID NO: 4339 - DNA, 22 bp, Artificial Sequence
  Description of Artificial Sequence: Synthetic oligonucleotide
  Category: MG29-1 TRAC Guides
  Description: MG29-1 Guide 24 Target Sequence
gtctgtgatatacacatcagaa

SEQ ID NO: 4340 - DNA, 22 bp, Artificial Sequence
  Description of Artificial Sequence: Synthetic oligonucleotide
  Category: MG29-1 TRAC Guides
  Description: MG29-1 Guide 25 Target Sequence
tctgtgatatacacatcagaat

SEQ ID NO: 4341 - DNA, 22 bp, Artificial Sequence
  Description of Artificial Sequence: Synthetic oligonucleotide
  Category: MG29-1 TRAC Guides
  Description: MG29-1 Guide 26 Target Sequence
ctttgtgacacatttgtttgag

SEQ ID NO: 4342 - DNA, 22 bp, Artificial Sequence
  Description of Artificial Sequence: Synthetic oligonucleotide
  Category: MG29-1 TRAC Guides
  Description: MG29-1 Guide 27 Target Sequence
gtgacacatttgtttgagaatc

SEQ ID NO: 4343 - DNA, 22 bp, Artificial Sequence
  Description of Artificial Sequence: Synthetic oligonucleotide
  Category: MG29-1 TRAC Guides
  Description: MG29-1 Guide 28 Target Sequence
tgacacatttgtttgagaatca

SEQ ID NO: 4344 - DNA, 22 bp, Artificial Sequence
  Description of Artificial Sequence: Synthetic oligonucleotide
  Category: MG29-1 TRAC Guides
  Description: MG29-1 Guide 29 Target Sequence
gtttgagaatcaaaatcggtga

SEQ ID NO: 4345 - DNA, 22 bp, Artificial Sequence
  Description of Artificial Sequence: Synthetic oligonucleotide
  Category: MG29-1 TRAC Guides
  Description: MG29-1 Guide 30 Target Sequence
tttgagaatcaaaatcggtgaa

SEQ ID NO: 4346 - DNA, 22 bp, Artificial Sequence
  Description of Artificial Sequence: Synthetic oligonucleotide
  Category: MG29-1 TRAC Guides
  Description: MG29-1 Guide 31 Target Sequence
gagaatcaaaatcggtgaatag

SEQ ID NO: 4347 - DNA, 22 bp, Artificial Sequence
  Description of Artificial Sequence: Synthetic oligonucleotide
  Category: MG29-1 TRAC Guides
  Description: MG29-1 Guide 32 Target Sequence
agaatcaaaatcggtgaatagg

SEQ ID NO: 4348 - DNA, 22 bp, Artificial Sequence
  Description of Artificial Sequence: Synthetic oligonucleotide
  Category: MG29-1 TRAC Guides
  Description: MG29-1 Guide 33 Target Sequence
tcactggatttagagtctctca

SEQ ID NO: 4349 - DNA, 22 bp, Artificial Sequence
  Description of Artificial Sequence: Synthetic oligonucleotide
  Category: MG29-1 TRAC Guides
  Description: MG29-1 Guide 34 Target Sequence
agagtctctcagctggtacacg

SEQ ID NO: 4350 - DNA, 22 bp, Artificial Sequence
  Description of Artificial Sequence: Synthetic oligonucleotide
  Category: MG29-1 TRAC Guides
  Description: MG29-1 Guide 35 Target Sequence
gagtctctcagctggtacacgg

SEQ ID NO: 4351 - DNA, 22 bp, Artificial Sequence
  Description of Artificial Sequence: Synthetic oligonucleotide
  Category: MG29-1 TRAC Guides
  Description: MG29-1 Guide 36 Target Sequence
ctgtgatgtcaagctggtcgag

SEQ ID NO: 4352 - DNA, 22 bp, Artificial Sequence
  Description of Artificial Sequence: Synthetic oligonucleotide
  Category: MG29-1 TRAC Guides
  Description: MG29-1 Guide 37 Target Sequence
caaagcttttctcgaccagctt

SEQ ID NO: 4353 - DNA, 22 bp, Artificial Sequence
  Description of Artificial Sequence: Synthetic oligonucleotide
  Category: MG29-1 TRAC Guides
  Description: MG29-1 Guide 38 Target Sequence
aaagcttttctcgaccagcttg

SEQ ID NO: 4354 - DNA, 22 bp, Artificial Sequence
  Description of Artificial Sequence: Synthetic oligonucleotide
  Category: MG29-1 TRAC Guides
  Description: MG29-1 Guide 39 Target Sequence
tctcgaccagcttgacatcaca

SEQ ID NO: 4355 - DNA, 22 bp, Artificial Sequence
  Description of Artificial Sequence: Synthetic oligonucleotide
  Category: MG29-1 TRAC Guides
  Description: MG29-1 Guide 40 Target Sequence
ctcgaccagcttgacatcacag

SEQ ID NO: 4356 - DNA, 22 bp, Artificial Sequence
  Description of Artificial Sequence: Synthetic oligonucleotide
  Category: MG29-1 TRAC Guides
  Description: MG29-1 Guide 41 Target Sequence
tcgaccagcttgacatcacagg

SEQ ID NO: 4357 - DNA, 22 bp, Artificial Sequence
  Description of Artificial Sequence: Synthetic oligonucleotide
  Category: MG29-1 TRAC Guides
  Description: MG29-1 Guide 42 Target Sequence
caaaacctgtcagtgattgggt

SEQ ID NO: 4358 - DNA, 22 bp, Artificial Sequence
  Description of Artificial Sequence: Synthetic oligonucleotide
  Category: MG29-1 TRAC Guides
  Description: MG29-1 Guide 43 Target Sequence
aaaacctgtcagtgattgggtt

SEQ ID NO: 4359 - DNA, 22 bp, Artificial Sequence
  Description of Artificial Sequence: Synthetic oligonucleotide
  Category: MG29-1 TRAC Guides
  Description: MG29-1 Guide 44 Target Sequence
ggttccgaatcctcctcctgaa

SEQ ID NO: 4360 - DNA, 22 bp, Artificial Sequence
  Description of Artificial Sequence: Synthetic oligonucleotide
  Category: MG29-1 TRAC Guides
  Description: MG29-1 Guide 45 Target Sequence
cgaatcctcctcctgaaagtgg

SEQ ID NO: 4361 - DNA, 22 bp, Artificial Sequence
  Description of Artificial Sequence: Synthetic oligonucleotide
  Category: MG29-1 TRAC Guides
  Description: MG29-1 Guide 46 Target Sequence
aatctgctcatgacgctgcggc

SEQ ID NO: 4362 - DNA, 22 bp, Artificial Sequence
  Description of Artificial Sequence: Synthetic oligonucleotide
  Category: MG29-1 TRAC Guides
  Description: MG29-1 Guide 47 Target Sequence
atctgctcatgacgctgcggct

SEQ ID NO: 4363 - DNA, 22 bp, Artificial Sequence
  Description of Artificial Sequence: Synthetic oligonucleotide
  Category: MG29-1 TRAC Guides
  Description: MG29-1 Guide 48 Target Sequence
aacccggccactttcaggagga

SEQ ID NO: 4364 - DNA, 22 bp, Artificial Sequence
  Description of Artificial Sequence: Synthetic oligonucleotide
  Category: MG29-1 TRAC Guides
  Description: MG29-1 Guide 49 Target Sequence
caggaggaggattcggaaccca

SEQ ID NO: 4365 - DNA, 22 bp, Artificial Sequence
  Description of Artificial Sequence: Synthetic oligonucleotide
  Category: MG29-1 TRAC Guides
  Description: MG29-1 Guide 50 Target Sequence
aggaggaggattcggaacccaa

SEQ ID NO: 4366 - DNA, 22 bp, Artificial Sequence
  Description of Artificial Sequence: Synthetic oligonucleotide
  Category: MG29-1 TRAC Guides
  Description: MG29-1 Guide 51 Target Sequence
ggaacccaatcactgacaggtt

SEQ ID NO: 4367 - DNA, 22 bp, Artificial Sequence
  Description of Artificial Sequence: Synthetic oligonucleotide
  Category: MG29-1 TRAC Guides
  Description: MG29-1 Guide 52 Target Sequence
tgaaagtttaggttcgtatctg

SEQ ID NO: 4368 - DNA, 22 bp, Artificial Sequence
  Description of Artificial Sequence: Synthetic oligonucleotide
  Category: MG29-1 TRAC Guides
  Description: MG29-1 Guide 53 Target Sequence
gaaagtttaggttcgtatctgt

SEQ ID NO: 4369 - DNA, 22 bp, Artificial Sequence
  Description of Artificial Sequence: Synthetic oligonucleotide
  Category: MG29-1 TRAC Guides
  Description: MG29-1 Guide 54 Target Sequence
aaagtttaggttcgtatctgta

SEQ ID NO: 4370 - RNA, 42 nt, Artificial Sequence
  Description of Artificial Sequence: Synthetic oligonucleotide
  Category: MG29-1 TRAC Guides
  Description: MG29-1 Guide 1 sgRNA synthesized
uaauuucuacuguuguagauaccgauuuugauucucaaacaa

SEQ ID NO: 4371 - RNA, 42 nt, Artificial Sequence
  Description of Artificial Sequence: Synthetic oligonucleotide
  Category: MG29-1 TRAC Guides
  Description: MG29-1 Guide 2 sgRNA synthesized
uaauuucuacuguuguagauugauucucaaacaaauguguca

SEQ ID NO: 4372 - RNA, 42 nt, Artificial Sequence
  Description of Artificial Sequence: Synthetic oligonucleotide
  Category: MG29-1 TRAC Guides
  Description: MG29-1 Guide 3 sgRNA synthesized
uaauuucuacuguuguagaugauucucaaacaaaugugucac

SEQ ID NO: 4373 - RNA, 42 nt, Artificial Sequence
  Description of Artificial Sequence: Synthetic oligonucleotide
  Category: MG29-1 TRAC Guides
  Description: MG29-1 Guide 4 sgRNA synthesized
uaauuucuacuguuguagauauucucaaacaaaugugucaca

SEQ ID NO: 4374 - RNA, 42 nt, Artificial Sequence
  Description of Artificial Sequence: Synthetic oligonucleotide
  Category: MG29-1 TRAC Guides
  Description: MG29-1 Guide 5 sgRNA synthesized
uaauuucuacuguuguagauucaaacaaaugugucacaaagu

SEQ ID NO: 4375 - RNA, 42 nt, Artificial Sequence
  Description of Artificial Sequence: Synthetic oligonucleotide
  Category: MG29-1 TRAC Guides
  Description: MG29-1 Guide 6 sgRNA synthesized
uaauuucuacuguuguagauugauguguauaucacagacaaa

SEQ ID NO: 4376 - RNA, 42 nt, Artificial Sequence
  Description of Artificial Sequence: Synthetic oligonucleotide
  Category: MG29-1 TRAC Guides
  Description: MG29-1 Guide 7 sgRNA synthesized
uaauuucuacuguuguagauaagagcaacagugcuguggccu

SEQ ID NO: 4377 - RNA, 42 nt, Artificial Sequence
  Description of Artificial Sequence: Synthetic oligonucleotide
  Category: MG29-1 TRAC Guides
  Description: MG29-1 Guide 8 sgRNA synthesized
uaauuucuacuguuguagaugcaugugcaaacgccuucaaca

SEQ ID NO: 4378 - RNA, 42 nt, Artificial Sequence
  Description of Artificial Sequence: Synthetic oligonucleotide
  Category: MG29-1 TRAC Guides
  Description: MG29-1 Guide 9 sgRNA synthesized
uaauuucuacuguuguagaucaugugcaaacgccuucaacaa

SEQ ID NO: 4379 - RNA, 42 nt, Artificial Sequence
  Description of Artificial Sequence: Synthetic oligonucleotide
  Category: MG29-1 TRAC Guides
  Description: MG29-1 Guide 10 sgRNA synthesized
uaauuucuacuguuguagauaacaacagcauuauuccagaag

SEQ ID NO: 4380 - RNA, 42 nt, Artificial Sequence
  Description of Artificial Sequence: Synthetic oligonucleotide
  Category: MG29-1 TRAC Guides
  Description: MG29-1 Guide 11 sgRNA synthesized
uaauuucuacuguuguagauuuccagaagacaccuucuuccc

SEQ ID NO: 4381 - RNA, 42 nt, Artificial Sequence
  Description of Artificial Sequence: Synthetic oligonucleotide
  Category: MG29-1 TRAC Guides
  Description: MG29-1 Guide 12 sgRNA synthesized
uaauuucuacuguuguagaucagaagacaccuucuuccccag

SEQ ID NO: 4382 - RNA, 42 nt, Artificial Sequence
  Description of Artificial Sequence: Synthetic oligonucleotide
  Category: MG29-1 TRAC Guides
  Description: MG29-1 Guide 13 sgRNA synthesized
uaauuucuacuguuguagauuggaauaaugcuguuguugaag

SEQ ID NO: 4383 - RNA, 42 nt, Artificial Sequence
  Description of Artificial Sequence: Synthetic oligonucleotide
  Category: MG29-1 TRAC Guides
  Description: MG29-1 Guide 14 sgRNA synthesized
uaauuucuacuguuguagauuugaaggcguuugcacaugcaa

SEQ ID NO: 4384 - RNA, 42 nt, Artificial Sequence
  Description of Artificial Sequence: Synthetic oligonucleotide
  Category: MG29-1 TRAC Guides
  Description: MG29-1 Guide 15 sgRNA synthesized
uaauuucuacuguuguagauaaggcguuugcacaugcaaagu

SEQ ID NO: 4385 - RNA, 42 nt, Artificial Sequence
  Description of Artificial Sequence: Synthetic oligonucleotide
  Category: MG29-1 TRAC Guides
  Description: MG29-1 Guide 16 sgRNA synthesized
uaauuucuacuguuguagaugcacaugcaaagucagauuugu

SEQ ID NO: 4386 - RNA, 42 nt, Artificial Sequence
  Description of Artificial Sequence: Synthetic oligonucleotide
  Category: MG29-1 TRAC Guides
  Description: MG29-1 Guide 17 sgRNA synthesized
uaauuucuacuguuguagaucacaugcaaagucagauuuguu

SEQ ID NO: 4387 - RNA, 42 nt, Artificial Sequence
  Description of Artificial Sequence: Synthetic oligonucleotide
  Category: MG29-1 TRAC Guides
  Description: MG29-1 Guide 18 sgRNA synthesized
uaauuucuacuguuguagauguugcuccaggccacagcacug

SEQ ID NO: 4388 - RNA, 42 nt, Artificial Sequence
  Description of Artificial Sequence: Synthetic oligonucleotide
  Category: MG29-1 TRAC Guides
  Description: MG29-1 Guide 19 sgRNA synthesized
uaauuucuacuguuguagauuugcuccaggccacagcacugu

SEQ ID NO: 4389 - RNA, 42 nt, Artificial Sequence
  Description of Artificial Sequence: Synthetic oligonucleotide
  Category: MG29-1 TRAC Guides
  Description: MG29-1 Guide 20 sgRNA synthesized
uaauuucuacuguuguagaucuccaggccacagcacuguugc

SEQ ID NO: 4390 - RNA, 42 nt, Artificial Sequence
  Description of Artificial Sequence: Synthetic oligonucleotide
  Category: MG29-1 TRAC Guides
  Description: MG29-1 Guide 21 sgRNA synthesized
uaauuucuacuguuguagaucucuugaaguccauagaccuca

SEQ ID NO: 4391 - RNA, 42 nt, Artificial Sequence
  Description of Artificial Sequence: Synthetic oligonucleotide
  Category: MG29-1 TRAC Guides
  Description: MG29-1 Guide 22 sgRNA synthesized
uaauuucuacuguuguagauaaguccauagaccucaugucua

SEQ ID NO: 4392 - RNA, 42 nt, Artificial Sequence
  Description of Artificial Sequence: Synthetic oligonucleotide
  Category: MG29-1 TRAC Guides
  Description: MG29-1 Guide 23 sgRNA synthesized
uaauuucuacuguuguagauugucugugauauacacaucaga

SEQ ID NO: 4393 - RNA, 42 nt, Artificial Sequence
  Description of Artificial Sequence: Synthetic oligonucleotide
  Category: MG29-1 TRAC Guides
  Description: MG29-1 Guide 24 sgRNA synthesized
uaauuucuacuguuguagaugucugugauauacacaucagaa

SEQ ID NO: 4394 - RNA, 42 nt, Artificial Sequence
  Description of Artificial Sequence: Synthetic oligonucleotide
  Category: MG29-1 TRAC Guides
  Description: MG29-1 Guide 25 sgRNA synthesized
uaauuucuacuguuguagauucugugauauacacaucagaau

SEQ ID NO: 4395 - RNA, 42 nt, Artificial Sequence
  Description of Artificial Sequence: Synthetic oligonucleotide
  Category: MG29-1 TRAC Guides
  Description: MG29-1 Guide 26 sgRNA synthesized
uaauuucuacuguuguagaucuuugugacacauuuguuugag

SEQ ID NO: 4396 - RNA, 42 nt, Artificial Sequence
  Description of Artificial Sequence: Synthetic oligonucleotide
  Category: MG29-1 TRAC Guides
  Description: MG29-1 Guide 27 sgRNA synthesized
uaauuucuacuguuguagaugugacacauuuguuugagaauc

SEQ ID NO: 4397 - RNA, 42 nt, Artificial Sequence
  Description of Artificial Sequence: Synthetic oligonucleotide
  Category: MG29-1 TRAC Guides
  Description: MG29-1 Guide 28 sgRNA synthesized
uaauuucuacuguuguagauugacacauuuguuugagaauca

SEQ ID NO: 4398 - RNA, 42 nt, Artificial Sequence
  Description of Artificial Sequence: Synthetic oligonucleotide
  Category: MG29-1 TRAC Guides
  Description: MG29-1 Guide 29 sgRNA synthesized
uaauuucuacuguuguagauguuugagaaucaaaaucgguga

SEQ ID NO: 4399 - RNA, 42 nt, Artificial Sequence
  Description of Artificial Sequence: Synthetic oligonucleotide
  Category: MG29-1 TRAC Guides
  Description: MG29-1 Guide 30 sgRNA synthesized
uaauuucuacuguuguagauuuugagaaucaaaaucggugaa

SEQ ID NO: 4400 - RNA, 42 nt, Artificial Sequence
  Description of Artificial Sequence: Synthetic oligonucleotide
  Category: MG29-1 TRAC Guides
  Description: MG29-1 Guide 31 sgRNA synthesized
uaauuucuacuguuguagaugagaaucaaaaucggugaauag

SEQ ID NO: 4401 - RNA, 42 nt, Artificial Sequence
  Description of Artificial Sequence: Synthetic oligonucleotide
  Category: MG29-1 TRAC Guides
  Description: MG29-1 Guide 32 sgRNA synthesized
uaauuucuacuguuguagauagaaucaaaaucggugaauagg

SEQ ID NO: 4402 - RNA, 42 nt, Artificial Sequence
  Description of Artificial Sequence: Synthetic oligonucleotide
  Category: MG29-1 TRAC Guides
  Description: MG29-1 Guide 33 sgRNA synthesized
uaauuucuacuguuguagauucacuggauuuagagucucuca

SEQ ID NO: 4403 - RNA, 42 nt, Artificial Sequence
  Description of Artificial Sequence: Synthetic oligonucleotide
  Category: MG29-1 TRAC Guides
  Description: MG29-1 Guide 34 sgRNA synthesized
uaauuucuacuguuguagauagagucucucagcugguacacg

SEQ ID NO: 4404 - RNA, 42 nt, Artificial Sequence
  Description of Artificial Sequence: Synthetic oligonucleotide
  Category: MG29-1 TRAC Guides
  Description: MG29-1 Guide 35 sgRNA synthesized
uaauuucuacuguuguagaugagucucucagcugguacacgg

SEQ ID NO: 4405 - RNA, 42 nt, Artificial Sequence
  Description of Artificial Sequence: Synthetic oligonucleotide
  Category: MG29-1 TRAC Guides
  Description: MG29-1 Guide 36 sgRNA synthesized
uaauuucuacuguuguagaucugugaugucaagcuggucgag

SEQ ID NO: 4406 - RNA, 42 nt, Artificial Sequence
  Description of Artificial Sequence: Synthetic oligonucleotide
  Category: MG29-1 TRAC Guides
  Description: MG29-1 Guide 37 sgRNA synthesized
uaauuucuacuguuguagaucaaagcuuuucucgaccagcuu

SEQ ID NO: 4407 - RNA, 42 nt, Artificial Sequence
  Description of Artificial Sequence: Synthetic oligonucleotide
  Category: MG29-1 TRAC Guides
  Description: MG29-1 Guide 38 sgRNA synthesized
uaauuucuacuguuguagauaaagcuuuucucgaccagcuug

SEQ ID NO: 4408 - RNA, 42 nt, Artificial Sequence
  Description of Artificial Sequence: Synthetic oligonucleotide
  Category: MG29-1 TRAC Guides
  Description: MG29-1 Guide 39 sgRNA synthesized
uaauuucuacuguuguagauucucgaccagcuugacaucaca

SEQ ID NO: 4409 - RNA, 42 nt, Artificial Sequence
  Description of Artificial Sequence: Synthetic oligonucleotide
  Category: MG29-1 TRAC Guides
  Description: MG29-1 Guide 40 sgRNA synthesized
uaauuucuacuguuguagaucucgaccagcuugacaucacag

SEQ ID NO: 4410 - RNA, 42 nt, Artificial Sequence
  Description of Artificial Sequence: Synthetic oligonucleotide
  Category: MG29-1 TRAC Guides
  Description: MG29-1 Guide 41 sgRNA synthesized
uaauuucuacuguuguagauucgaccagcuugacaucacagg

SEQ ID NO: 4411 - RNA, 42 nt, Artificial Sequence
  Description of Artificial Sequence: Synthetic oligonucleotide
  Category: MG29-1 TRAC Guides
  Description: MG29-1 Guide 42 sgRNA synthesized
uaauuucuacuguuguagaucaaaaccugucagugauugggu

SEQ ID NO: 4412 - RNA, 42 nt, Artificial Sequence
  Description of Artificial Sequence: Synthetic oligonucleotide
  Category: MG29-1 TRAC Guides
  Description: MG29-1 Guide 43 sgRNA synthesized
uaauuucuacuguuguagauaaaaccugucagugauuggguu

SEQ ID NO: 4413 - RNA, 42 nt, Artificial Sequence
  Description of Artificial Sequence: Synthetic oligonucleotide
  Category: MG29-1 TRAC Guides
  Description: MG29-1 Guide 44 sgRNA synthesized
uaauuucuacuguuguagaugguuccgaauccuccuccugaa

SEQ ID NO: 4414 - RNA, 42 nt, Artificial Sequence
  Description of Artificial Sequence: Synthetic oligonucleotide
  Category: MG29-1 TRAC Guides
  Description: MG29-1 Guide 45 sgRNA synthesized
uaauuucuacuguuguagaucgaauccuccuccugaaagugg

SEQ ID NO: 4415 - RNA, 42 nt, Artificial Sequence
  Description of Artificial Sequence: Synthetic oligonucleotide
  Category: MG29-1 TRAC Guides
  Description: MG29-1 Guide 46 sgRNA synthesized
uaauuucuacuguuguagauaaucugcucaugacgcugcggc

SEQ ID NO: 4416 - RNA, 42 nt, Artificial Sequence
  Description of Artificial Sequence: Synthetic oligonucleotide
  Category: MG29-1 TRAC Guides
  Description: MG29-1 Guide 47 sgRNA synthesized
uaauuucuacuguuguagauaucugcucaugacgcugcggcu

SEQ ID NO: 4417 - RNA, 42 nt, Artificial Sequence
  Description of Artificial Sequence: Synthetic oligonucleotide
  Category: MG29-1 TRAC Guides
  Description: MG29-1 Guide 48 sgRNA synthesized
uaauuucuacuguuguagauaacccggccacuuucaggagga

SEQ ID NO: 4418 - RNA, 42 nt, Artificial Sequence
  Description of Artificial Sequence: Synthetic oligonucleotide
  Category: MG29-1 TRAC Guides
  Description: MG29-1 Guide 49 sgRNA synthesized
uaauuucuacuguuguagaucaggaggaggauucggaaccca

SEQ ID NO: 4419 - RNA, 42 nt, Artificial Sequence
  Description of Artificial Sequence: Synthetic oligonucleotide
  Category: MG29-1 TRAC Guides
  Description: MG29-1 Guide 50 sgRNA synthesized
uaauuucuacuguuguagauaggaggaggauucggaacccaa

SEQ ID NO: 4420 - RNA, 42 nt, Artificial Sequence
  Description of Artificial Sequence: Synthetic oligonucleotide
  Category: MG29-1 TRAC Guides
  Description: MG29-1 Guide 51 sgRNA synthesized
uaauuucuacuguuguagauggaacccaaucacugacagguu

SEQ ID NO: 4421 - RNA, 42 nt, Artificial Sequence
  Description of Artificial Sequence: Synthetic oligonucleotide
  Category: MG29-1 TRAC Guides
  Description: MG29-1 Guide 52 sgRNA synthesized
uaauuucuacuguuguagauugaaaguuuagguucguaucug

SEQ ID NO: 4422 - RNA, 42 nt, Artificial Sequence
  Description of Artificial Sequence: Synthetic oligonucleotide
  Category: MG29-1 TRAC Guides
  Description: MG29-1 Guide 53 sgRNA synthesized
uaauuucuacuguuguagaugaaaguuuagguucguaucugu

SEQ ID NO: 4423 - RNA, 42 nt, Artificial Sequence
  Description of Artificial Sequence: Synthetic oligonucleotide
  Category: MG29-1 TRAC Guides
  Description: MG29-1 Guide 54 sgRNA synthesized
uaauuucuacuguuguagauaaaguuuagguucguaucugua

SEQ ID NO: 4424 - DNA, 504 bp, Artificial Sequence
  Description of Artificial Sequence: Synthetic polynucleotide
  Category: Transgene donor (AAV genome) #3028
  Description: Transgene 5' homology arm
ttaattaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgacc

SEQ ID NO: 4425 - DNA, 378 bp, Artificial Sequence
  Description of Artificial Sequence: Synthetic polynucleotide
  Category: Transgene donor (AAV genome) #3028
  Description: Transgene 3' homology arm
tgaaagcttgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggaacttgtttattgcagcttataatggttacaaataaagcaatagcatcacaaatttcacaaataaagcatttttttcactgcattctagttgtggtttgtccaaactcatcaatgtatctta

SEQ ID NO: 4426 - DNA, 14 bp, Artificial
  other DNA
  modified_base (6)..(10): N = A, C, T, G, or other
  misc_feature (6)..(9): n is a, c, g, or t
tctacnnnngtaga

SEQ ID NO: 4427 - DNA, 15 bp, Artificial
  other DNA
  modified_base (6)..(10): N = A, C, T, G, or other
  misc_feature (6)..(10): n is a, c, g, or t
tctacnnnnngtaga

SEQ ID NO: 4428 - DNA, 14 bp, Artificial
  other DNA
  modified_base (6)..(9): N = A, C, T, G, or other
  misc_feature (6)..(9): n is a, c, g, or t
cctgcnnnngcagg

SEQ ID NO: 4429 - DNA, 13 bp, Artificial
  other DNA
  modified_base (6)..(8): N = A, C, T, G, or other
  misc_feature (6)..(8): n is a, c, g, or t
cctgcnnngcagg

SEQ ID NO: 4430 - DNA, 13 bp, Artificial
  other DNA
  misc_feature (6)..(8): n is a, c, g, or t
tctacnnngtaga

SEQ ID NO: 4431 - DNA, 11 bp, Artificial
  other DNA
  misc_feature (5)..(6): n is a, c, g, or t
tcacnngtaga

SEQ ID NO: 4432 - DNA, 15 bp, Artificial
  other DNA
  misc_feature (5)..(10): n is a, c, g, or t
tcacnnnnnngtaga

SEQ ID NO: 4433 - DNA, 17 bp, Artificial
  other DNA
  misc_feature (5)..(12): n is a, c, g, or t
tcacnnnnnnnngtaga

SEQ ID NO: 4434 - DNA, 16 bp, Artificial
  other DNA
  misc_feature (5)..(11): n is a, c, g, or t
tcacnnnnnnngtaga

SEQ ID NO: 4435 - DNA, 11 bp, Artificial
  other DNA
  misc_feature (6)..(6): n is a, c, g, or t
tctacngtaga

SEQ ID NO: 4436 - protein, 38 aa, Artificial
  Consensus RuvCI
  misc_feature (6)..(7): Xaa can be any naturally occurring amino acid
NNPDVXXIGIDRGERHLLYLTVIBQKGEILEQKSLNEI

SEQ ID NO: 4437 - protein, 18 aa, Artificial
  Consensus RuvCII
AZLMIEYNAIVVLEDLNF

SEQ ID NO: 4438 - protein, 30 aa, Artificial
  Consensus RuvCIII
  misc_feature (1)..(2): Xaa can be any naturally occurring amino acid
XXLPKDADANGAYHIALKGLWLLQQIKNSD

SEQ ID NO: 4439 - protein, 38 aa, Franciscella tularensis
KANDVHILSIDRGERHLAYYTLVDGKGNIIKQDTFNII

SEQ ID NO: 4440 - protein, 18 aa, Franciscella tularensis
AKLVIEYNAIVVFEDLNF

SEQ ID NO: 4441 - protein, 30 aa, Franciscella tularensis
KNMPQDADANGAYHIGLKGLMLLGRIKNNQ

SEQ ID NO: 4442 - protein, 38 aa, Acidaminococcus sp
EHPETPIIGIDRGERNLIYITVIDSTGKILEQRSLNTI

SEQ ID NO: 4443 - protein, 18 aa, Acidaminococcus sp
VDLMIHYQAVVVLENLNF

SEQ ID NO: 4444 - protein, 29 aa, Acidaminococcus sp
EWPMDADANGAYHIALKGQLLLNHLKESK

SEQ ID NO: 4445 - protein, 38 aa, Moraxella bovoculi
QYDEVNVIGIDRGERHLLYLTVINSKGEILEQCSLNDI

SEQ ID NO: 4446 - protein, 18 aa, Moraxella bovoculi
SQLMLKYNAIVVLEDLNF

SEQ ID NO: 4447 - protein, 30 aa, Moraxella bovoculi
DTQPQNADANGAYHIALKGLWLLNELKNSD

SEQ ID NO: 4448 - protein, 38 aa, Lachnospiraceae bacterium ND2006
HDDNPYVIGIDRGERNLLYIVVVDGKGNIVEQYSLNEI

SEQ ID NO: 4449 - protein, 18 aa, Lachnospiraceae bacterium ND2007
CELVEKYDAVIALEDLNS

SEQ ID NO: 4450 - protein, 30 aa, Lachnospiraceae bacterium ND2008
AILPKNADANGAYNIARKVLWAIGQFKKAE

SEQ ID NO: 4451 - protein, 70 aa, Artificial
  Consensus WEDII/PI Domain
  misc_feature (7)..(7): Xaa can be any naturally occurring amino acid
  misc_feature (14)..(14): Xaa can be any naturally occurring amino acid
  misc_feature (21)..(21): Xaa can be any naturally occurring amino acid
  misc_feature (33)..(33): Xaa can be any naturally occurring amino acid
  misc_feature (40)..(45): Xaa can be any naturally occurring amino acid
  misc_feature (47)..(47): Xaa can be any naturally occurring amino acid
LLNGWDXNKEKDNXAVILRKXGKYYLGIMDKKXNKVFDNXXXXXXSXYEKMVYKLLPGANKMLPKVFFSK

SEQ ID NO: 4452 - protein, 72 aa, franciscella tularensis
LANGWDKNKEPDNTAILFIKDDKYYLGNMNKKNNKIFDDKAIKENKGEGYKKIVYKLLPGANKMLPKVFFSA

SEQ ID NO: 4453 - protein, 73 aa, Unknown
  CasCas12 WEDII.PI Domain
LASGWDVNKEKNNGAILFVKNGLYYLGIMPKQKGRYKALSFEPTEKTSEGFDKMYYDYFPDAAKMIPKCSTQL

SEQ ID NO: 4454 - protein, 69 aa, Moraxella bovoculi
LANGWDLNKEKDNFGVILQKDGCYYLALLDKAHKKVFDNAPNTGKSIYQKMIYKYLEVRKQFPKVFFSK

SEQ ID NO: 4455 - protein, 71 aa, Lachnospiraceae bacterium ND2006
FMGGWDKDKETDYRATILRYGSKYYLAIMDKKYAKCLQKIDKDDVNGNYEKINYKLLPGPNKMLPKVFFSK

SEQ ID NO: 4456 - protein, 81 aa, Unknown
  MG26-2 RuvC
LYYYGIDRGDEELLTLGIFKFEDQDISPSDSNKSGTYKKPIPIDLEVWELPKDKYLKLVPYNGTKYTEAYKVISYADKEGL

SEQ ID NO: 4457 - protein, 27 aa, Unknown
  MG26-2 RuvC
FLESSDDVAAYNIAKRGLELILKKPQS

SEQ ID NO: 4458 - protein, 65 aa, Acidaminococcus sp
TPIIGIDRGERNLIYITVIDSTGKILEQRSLNTIQQFDYQKKLDNREKERVAARQAWSVVGTIKD

SEQ ID NO: 4459 - protein, 50 aa, Acidaminococcus sp
WPMDADANGAYHIALKGDLLLNHLKESKDLKLQNGISNQDWLAYIQELRN

SEQ ID NO: 4460 - RNA, 36 nt, Lachnospiraceae bacterium ND2006
guuucaaagauuaaauaauuucuacuaaguguagau

SEQ ID NO: 4461 - RNA, 37 nt, Artificial
  Consensus effector repeat
  misc_feature (11)..(11): n is a, c, g, or u
sgucuaaracnamwauuaaauuucuacuguuguagau

SEQ ID NO: 4462 - RNA, 36 nt, Artificial
  Consensus effector repeat
guuauaaggauaahauaaaugccugcugkugcaggc

SEQ ID NO: 4463 - RNA, 35 nt, Artificial
  MG61-2 effector repeat
guuauaaggauaaguaaaaugccugcuggugcagg

SEQ ID NO: 4464 - RNA, 23 nt, Artificial
  MG11-1 effector repeat
uacgaaaauaccuacuuguuagg

SEQ ID NO: 4465 - RNA, 35 nt, Artificial
  MG61-2 effector repeat
guuauaaggauaauagaaaugucugcuguugcagg

SEQ ID NO: 4466 - RNA, 35 nt, Artificial
  MG61-2 effector repeat
guuauaaggauaauagaaaugccugcuggugcagg

SEQ ID NO: 4467 - RNA, 36 nt, Artificial
  MG61-3 effector repeat
guuauaaggaagcaauaaaugccugcugaugcaggc

SEQ ID NO: 4468 - protein, 81 aa, Unknown; identical to SEQ ID NO: 4456
  MG60-9 effector RuvC domain

SEQ ID NO: 4469 - protein, 27 aa, Unknown
  MG60-9 effector RuvC domain
FLESSDDVAAYNIAKRGLELILKKPQS

SEQ ID NO: 4470 - protein, 65 aa, Acidaminococcus sp; identical to SEQ ID NO: 4458

SEQ ID NO: 4471 - protein, 50 aa, Acidaminococcus sp; identical to SEQ ID NO: 4459

SEQ ID NO: 4472 - protein, 48 aa, Artificial
  MG37_53_54 effector consensus
  misc_feature (1)..(1): Xaa can be any naturally occurring amino acid
  misc_feature (44)..(45): Xaa can be any naturally occurring amino acid
XEENKKRKGHAKLILSRLPGLRVLSVDLGHRYAAACAVWEAISXXQFR

SEQ ID NO: 4473 - protein, 85 aa, Artificial
  MG37_53_54 effector consensus
  misc_feature (28)..(28): Xaa can be any naturally occurring amino acid
  misc_feature (31)..(31): Xaa can be any naturally occurring amino acid
  misc_feature (42)..(42): Xaa can be any naturally occurring amino acid
  misc_feature (48)..(48): Xaa can be any naturally occurring amino acid
  misc_feature (80)..(80): Xaa can be any naturally occurring amino acid
  misc_feature (84)..(84): Xaa can be any naturally occurring amino acid
FAPCHAVVIEBLTNYRPDETRTRRENRXLMXWSSAKVRKYLXEECQLXGLHLREVPPAYTSRQDSRTGAPGIRCSDVPVXDFLXG

SEQ ID NO: 4474 - protein, 85 aa, Unknown
  MG37-1 effector region
DLPCHAIVIESLRNYRPDDLQTRRENRALMEWSSGKVRKYLEEACYLYGLHLREVPPNYTSRQCSRTGLPGIRCADVPIEQFRAA

SEQ ID NO: 4475 - protein, 86 aa, Unknown
  MG37-2 effector region
FAPCHAVVIENLTNYRPDEVRSRRENRQLMDWCAAKVKKYLNESCDLHGILLREVQAAYTSRQDSLSGAPGVRCADVPIRDFMACG

SEQ ID NO: 4476 - protein, 86 aa, Unknown
  MG37-3 effector region
RFAPCYAVVIEDLTHYRPEETRTRRENRQLMSWSSSKVKKYLAEACQLHGLHLREVSAGYTSRQDSRTGAPGIRCHDVPVKEFMRS

SEQ ID NO: 4477 - protein, 86 aa, Unknown
  MG37-4 effector region
RFQACHAVVIEDLSHYRPEETRTRRENRATMDWKSAETRKRLADHCQLYGLHLRDVNPQYTSRQDSRTGAPGCRCVDVSVADFLTK

SEQ ID NO: 4478 - protein, 86 aa, Unknown
  MG37-5 effector region
FKPCHALIIENLKNYRPDELQTRRENRQLMTWSSHRIFDFLKDECDLFGIHLRTVSPSYTSRQDSRTGAPGIRCTDIPLTNFLKEN

SEQ ID NO: 4479 - protein, 86 aa, Unknown
  MG37-6 effector region
FQPCDLVVIESLTNYRPEQTRSRAENRRIMQWASARVGEMLRDECEIYGIALYETPAAYTSRQDSRTGLPGFRFKEVPVAAFVNGG

SEQ ID NO: 4480 - protein, 85 aa, Unknown
  MG37-7 effector region
YATCHAVVVEDLDNYRPDEVRTRRENRQLMQWSAAKVRDYLAESCQLHGLHLRKVYAGYTSRQDSRTGRPGVRCSDVPVPDFLRR

SEQ ID NO: 4481 - protein, 86 aa, Unknown
  MG53-1 effector region
KHKVDYIVFENLAGYRPEMEFGRKVNAALMTWNRRELVEFVKMEAAPLGIHVYEWVPPHHTSRFCHRCGAVGHRFSHIRSIDAKKD

SEQ ID NO: 4482 - protein, 83 aa, Unknown
  MG54-1 effector region
YPRADLLIVEKLEGFIPDAARERGINRALVAWNRGQLVTRIKEVAADAGLKLFPVHPAGTSQCCSRCGALGRRYSIVRDQQTG

SEQ ID NO: 4483 - protein, 33 aa, Artificial
  MG37_53_54 effector consensus
  MOD_RES (1)..(1): Any amino acid
  MOD_RES (3)..(3): Leucine or Isoleucine
  misc_feature (26)..(26): Xaa can be any naturally occurring amino acid
XGXQADLNAAANIGLRALLDPDWAGXWWYVPCD

SEQ ID NO: 4484 - protein, 48 aa, Unknown
  MG37-1 effector region
GNDRVSARPNDWSSKRALQADLNAAANIGLRALLDPDFPGTWWYVPCT

SEQ ID NO: 4485 - protein, 33 aa, Unknown
  MG37-2 effector region
HGTQADMNAAANIGLRALLDPDWAGRWWYVPCN

SEQ ID NO: 4486 - protein, 33 aa, Unknown
  MG37-3 effector region
KGLHADLNAAANIGLRVLTDPDWPGKWWYVPCD

SEQ ID NO: 4487 - protein, 33 aa, Unknown
  MG37-4 effector region
AGIQADLNAAANIGLRALMDPDFLGTWWYVPCD

SEQ ID NO: 4488 - protein, 33 aa, Unknown
  MG37-5 effector region
KGIHADINAAANIGLRALLDPDWAGSWWYVPCN

SEQ ID NO: 4489 - protein, 31 aa, Unknown
  MG37-6 effector region
IQADINAAGNIALRGVTDPDWAGSWWRVNIQ

SEQ ID NO: 4490 - protein, 33 aa, Unknown
  MG37-7 effector region
KGLQADLNAAANIGLKALLDPDWPGKWWYVPCD

SEQ ID NO: 4491 - protein, 28 aa, Unknown
  MG53-1
ADYNAAMNLARKLADEFHAYQRYAYDRE

SEQ ID NO: 4492 - protein, 25 aa, Unknown
  MG54-1
ADHNASLNLHRRFVLDDRAVAAFFA

SEQ ID NO: 4493 - protein, 44 aa, Artificial
  MG37_53_54 effector consensus
  misc_feature (1)..(1): Xaa can be any naturally occurring amino acid
  misc_feature (4)..(5): Xaa can be any naturally occurring amino acid
  misc_feature (10)..(10): Xaa can be any naturally occurring amino acid
  misc_feature (21)..(21): Xaa can be any naturally occurring amino acid
  misc_feature (23)..(23): Xaa can be any naturally occurring amino acid
  misc_feature (40)..(41): Xaa can be any naturally occurring amino acid
  misc_feature (43)..(43): Xaa can be any naturally occurring amino acid
XWRXXLRWLXDWILPRGKSAXDXSIRHVGGLSLTRIATLXXLXR

SEQ ID NO: 4494 - protein, 43 aa, Unknown
  MG37-1 effector region
DWRSHLRRLQDWARPPASKGSQAIRHVGGLSLTRLATLTELRR

SEQ ID NO: 4495 - protein, 43 aa, Unknown
  MG37-2 effector region
RWCKRLRWIKDWLLPRGSGAQCNSIRRVGGLSLRRLNNLRALY

SEQ ID NO: 4496 - protein, 44 aa, Unknown
  MG37-3 effector region
RWKKQLRWFKDWILPRGKYASDPSIRKVGGLSLTRLATLTEFRR

SEQ ID NO: 4497 - protein, 44 aa, Unknown
  MG37-4 effector region
QWRSRLKWLSRWLLPRGGSRRDGSRRHVGGLSLTRISTLIDFRR

SEQ ID NO: 4498 - protein, 50 aa, Unknown
  MG37-5 effector region
KGKTKLCRQCIRLVRDWIMPRRDSDYVFSKQFRNVGGLSLTRINTFKKLY

SEQ ID NO: 4499 - protein, 44 aa, Unknown
  MG37-6 effector region
NIRIALRILRNWIFKGIEPYSDSRACKGVGGLSLNRIATMQMAY

SEQ ID NO: 4500 - protein, 43 aa, Unknown
  MG37-7 effector region
GLRVHLHEVHRWILPRGKGRADATIRHAGGLSLRRLATIRGIW

SEQ ID NO: 4501 - protein, 36 aa, Unknown
  MG53-1 effector region
HGHGRLPEPLKPVAVEILDVAGTSLVHIQRHQDERR

SEQ ID NO: 4502 - protein, 42 aa, Unknown
  MG54-1 effector region
GIRVLRSRNQWLALEETAGTHPGRWSAGPDLAHIAAHKREIR

SEQ ID NO: 4503 - protein, 77 aa, Artificial
  MG effector RuvC consensus
  misc_feature (10)..(10): Xaa can be any naturally occurring amino acid
  misc_feature (39)..(39): Xaa can be any naturally occurring amino acid
  misc_feature (50)..(51): Xaa can be any naturally occurring amino acid
  misc_feature (57)..(58): Xaa can be any naturally occurring amino acid
  misc_feature (71)..(71): Xaa can be any naturally occurring amino acid
  misc_feature (74)..(74): Xaa can be any naturally occurring amino acid
  misc_feature (77)..(77): Xaa can be any naturally occurring amino acid
AQRSAGAVGXDLGVRYLAVLSDEQAPQRFSVRLATGYTXIGIEDLAVAGXXASAGVXXDRDVNAARNIRAXAVXMYX

SEQ ID NO: 4504 - protein, 76 aa, Unknown
  MG84-16 effector RuvC domain
IVDSNKVLGIDMGIIFPVYMAIHGTLIRDIVDFALRNRCGIIQMEKLEGINKDKTETNADYNAALNIADPDIENLI

SEQ ID NO: 4505 - protein, 76 aa, Unknown
  MG84-15 effector RuvC domain
IVDSNKVLGIDMGIIFPVYMAIHGTLIRDIVDFALRNRCGIIQMEKLEGINKDKTETNADYNAALNIANPDIENLI

SEQ ID NO: 4506 - protein, 76 aa, Unknown
  MG84-3 effector RuvC domain
KFIEGRTMGIDLGIVKPVVMAFNDNPVHFIVDIAVKYKCKTIQMEDLSGISKDSTGLNADWNAALNIATPNIEEII

SEQ ID NO: 4507 - protein, 76 aa, Unknown
  MG84-2 effector RuvC domain
KFIDGRTMGIDLGIVKPLVIAFNDNPAHFVVNLALKYKCKTIQMEDLTGISKDSTGINADWNAALNISIPGIEKII

SEQ ID NO: 4508 - protein, 76 aa, Unknown
  MG84-1 effector RuvC domain
KFIDGRTMGIDLGIVKPLVIAFNDNPAHFVVDLAQKYKCKTIQMEDLTGISKDSTGINADWNAALNISIPGIEKII

SEQ ID NO: 4509 - protein, 76 aa, Unknown
  MG84-13 effector RuvC domain
KLRESRVMGIDLGVVKPLVIAYNDMPPHHVVDLAVKYGCKTIQMEDLTGISKKDTGINADRNAATNIAQPGIEKII

SEQ ID NO: 4510 - protein, 76 aa, Unknown
  MG84-14 effector RuvC domain
KLRESRVMGIDLGVVKPLVIAYNDMPLHHVVNLAVKYGCKTIQMEDLTGISKEDTGINADWNAATNIAQPGIEKII

SEQ ID NO: 4511 - protein, 76 aa, Unknown; identical to SEQ ID NO: 4510
  MG84-12 effector RuvC domain

SEQ ID NO: 4512 - protein, 76 aa, Unknown
  MG84-11effector RuvC domain
KLRESRVMGIDLGVVKPLVIAYNDMPLHHVVNLAVKYGCKTIQMEDLTGISKKDTGINADRNAATNIAQPGIEKII

SEQ ID NO: 4513 - protein, 76 aa, Unknown
  MG84-10 effector RuvC domain
ELRPSRVMGIDLGVVKPLVIAYNDTPVHQVVDLAVKYKCKTIQMEDLSGISKDDITLNADWNAARNIAQPGIEEII

SEQ ID NO: 4514 - protein, 76 aa, Unknown
  MG84-9 effector RuvC domain
ELRPSRVMGIDLGVVKPLVIAYNDTPVHQVVDLAVKYKCKTIQMEDLSGISKDDITLNADWNAALNIAQPGIEEII

SEQ ID NO: 4515 - protein, 76 aa, Unknown; identical to SEQ ID NO: 4513
  MG84-8 effector RuvC domain

SEQ ID NO: 4516 - protein, 76 aa, Unknown; identical to SEQ ID NO: 4514
  MG84-7 effector RuvC domain

SEQ ID NO: 4517 - protein, 75 aa, Unknown
  MG84-4 effector RuvC domain
ELRPSRVMGIDLGVKPLVIAYNDTPVHQVVDLAVKYKCKTIQMEDLSGISKDDISLNADWNAALNIAQPGIEEII

SEQ ID NO: 4518 - protein, 76 aa, Unknown
  MG84-5 effector RuvC domain
ELRPSRVMGIDLGVVKPLVIAYNDTPVHQVVDLAVKYKCKTIQMEDLSGISKDDISLNADWNAARNIAQPGIEEII

SEQ ID NO: 4519 - protein, 76 aa, Unknown; identical to SEQ ID NO: 4518
  MG84-6 effector RuvC domain

SEQ ID NO: 4520 - protein, 77 aa, Unknown
  MG81-18 effector RuvC domain
AQRSAGAVGVDLGVRYLAVLSDEQAPQRFSKRLTTGYTLIGLEDLAVAGMTASAGVRIDRDVNAARNIRAEAVRMYE

SEQ ID NO: 4521 - protein, 77 aa, Unknown; identical to SEQ ID NO: 4520
  MG81-17 effector RuvC domain

SEQ ID NO: 4522 - protein, 77 aa, Unknown
  MG81-9 effector RuvC domain
AQRSAGAVGVDLGVRYLAALSDEQAPQRFSKRLSTGYTLIGLEDLAVAGMTASAGVRIDRDVNAARNIRAEAVRMYE

SEQ ID NO: 4523 - protein, 77 aa, Unknown
  MG81-6 effector RuvC domain
AQRAAGAVGVDLGVRYLAALSDEQAPQRFSKRLTTGYTLIGLEDLAVAGMTASAGVRIDRDVNAARNIRAEAVRMYE

SEQ ID NO: 4524 - protein, 77 aa, Unknown; identical to SEQ ID NO: 4522
  MG81-11 effector RuvC domain

SEQ ID NO: 4525 - protein, 77 aa, Unknown
  MG81-7 effector RuvC domain
AQRAASAVGVDLGVRYLAALSDEQAPRRFSKRLSTGYTLIGLEDLAVAGMTASAGVRIDRDVNAARNIRAEAVRMYE

SEQ ID NO: 4526 - protein, 77 aa, Unknown; identical to SEQ ID NO: 4522
  MG81-8 effector RuvC domain

SEQ ID NO: 4527 - protein, 77 aa, Unknown; identical to SEQ ID NO: 4522
  MG81-13effector RuvC domain

SEQ ID NO: 4528 - protein, 77 aa, Unknown
  MG81-5effector RuvC domain
AQRTAGAVGVDLGVRYLAALSDEQAPQRFSKRLSTGYTLIGLEDLAVAGMTASAGVRIDRDVNAARNIRAEAVRMYE

SEQ ID NO: 4529 - protein, 77 aa, Unknown
  MG81-12 effector RuvC domain
AQRAAGAVGVDLGVRYLAALSDEQAPQRFSKRLATGYTLIGLEDLAVAGMTASAGVRIDRDVNAARNIRAEAVRMCE

SEQ ID NO: 4530 - protein, 77 aa, Unknown
  MG81-1 effector RuvC domain
AQRAAGAVGVDLGVRYLAALSDEQAPQRFSKRLTTGYTLIGLEDLAVAGMTASAGVRIDRDVNAARNIRAEAVRMHE

SEQ ID NO: 4531 - protein, 77 aa, Unknown
  MG81-4 effector RuvC domain
AQRAAGAVGVDLGVRYLAALSDEQAPQRFSKRLATRYTLIGLEDLAVAGMTASAGVRIDRDVNAARNIRAEAVRMYE

SEQ ID NO: 4532 - protein, 77 aa, Unknown
  MG81-3 effector RuvC domain
AQRAAGAVGVDLGVRYLAALSDEQAPQRFSKRLATGYTLIGLEDLAVAGMTASAGVRIDRDVNAARNIRAEAVRMYE

SEQ ID NO: 4533 - protein, 77 aa, Unknown
  MG81-15 effector RuvC domain
AQRSAGAVGVDLGVRYLAALSDEQAPQRFSKRLATGYTLIGLEDLAVAGMTASAGVRIDRDVNAARNIRAEAVRMYE

SEQ ID NO: 4534 - protein, 77 aa, Unknown
  MG81-10 effector RuvC domain
AQRSAGAVGVDLGVRYLAALSDEQAPQRFSKRLSTGYTLIGLEDLAVAGMTASAGVRIDRDVNAARNIRAEAVRMHE

SEQ ID NO: 4535 - protein, 77 aa, Unknown
  MG81-2 effector RuvC domain
AQRAAGAVGIDLGVRYLAALSDEQAPQRFSKRLATGYTLIGLEDLAVAGMTASAGVRIDRDVNAARNIRAEAVRMYE

SEQ ID NO: 4536 - protein, 77 aa, Unknown
  MG90-2 effector RuvC domain
ARSRGETVGVDIGWRRRIARWWGTDQVLDVVWLCRQYGRIGVEAPMVAGLVRKVSGTEDQDLTAAKNLARRAVALED

SEQ ID NO: 4537 - protein, 70 aa, Unknown
  MG91-1 effector RuvC domain
QKLGLGPVGVDPGMHQIAVYSDAHKLLSYGNVFYIEDPRSAEKKRRMGHKVQRDMKSGYVLSACKMKGYD

SEQ ID NO: 4538 - protein, 68 aa, Unknown
  MG91-2 effector RuvC domain
RTLGKGNVGIDIGPSTVAISANEILSLGDTFIVENNPTSAWAKRAGNTHQRDMLAAFNLQHIDLKKYN

SEQ ID NO: 4539 - protein, 65 aa, Unknown
  MG91-3 effector RuvC domain
RTLGNGDVGVDPGVSSLANSVLSEGNVLKIEDNDISNWNKNLGNTHHRDAHAAFNLKHYNTKHYD

SEQ ID NO: 4540 - DNA, 40 bp, Mus musculus
  conflict (1)..(1): C
  conflict (11)..(34): deletion
  conflict (12)..(12): G
  conflict (13)..(13): G
  conflict (16)..(16): A
  conflict (18)..(18): A
  conflict (19)..(19): T
  conflict (20)..(20): G
  conflict (21)..(21): C
  conflict (24)..(24): C
  conflict (29)..(29): G
tcctgtaacgatcgggacctggcatcttcagggagtagct

SEQ ID NO: 4541 - DNA, 142 bp, Artificial Sequence
  in vitro target
cgacaggtttcccgactggaaaaggtttggtcgaggcttgcgacgtggtggctaatttaagccagccccgacaaaaggtttggtcgaggcttgcgacgtggtggctaatttaagccagccccgacacccgccaacacccgct

SEQ ID NO: 4542 - RNA, 36 nt, Artificial Sequence
  MG28-1 repeat
gucuauaaagacaauuaaauuucuacuauuguagau

SEQ ID NO: 4543 - RNA, 36 nt, Artificial Sequence
  MG29-1 repeat
gucuaagaccuuacuuaaauuucuacuguuguagau

SEQ ID NO: 4544 - RNA, 36 nt, Artificial Sequence
  MG30-1 repeat
cucuagggcuacccuuaaauuucuacuauuguagau

SEQ ID NO: 4545 - RNA, 36 nt, Artificial Sequence
  MG31-1 repeat
guuuaagacaaauacaaaauuucuacuguuguagau

SEQ ID NO: 4546 - RNA, 36 nt, Artificial Sequence
  Unidentified microoganism; MG32-1 repeat
cuuuaagagacuccuucaauuucuacuguuguagau

SEQ ID NO: 4547 - DNA, 123 bp, Artificial Sequence
  in vitro target (Sanger sequencing)
  misc_feature (54)..(54): n is a, c, g, or t
  misc_feature (56)..(56): n is a, c, g, or t
  misc_feature (58)..(58): n is a, c, g, or t
  misc_feature (60)..(61): n is a, c, g, or t
  misc_feature (67)..(68): n is a, c, g, or t
  misc_feature (86)..(86): n is a, c, g, or t
cgacaggtttcccgactggaaaaggtttggtcgaggcttgcgacgtggtggcancngnanngggccnnaggcttgcgacgtttttnttatttaagccagccccgacacccgccaacacccgct
